US012668824B2

(12) United States Patent
Sivaramakrishnan et al.

(10) Patent No.: US 12,668,824 B2
(45) Date of Patent: Jun. 30, 2026

(54) ENGINEERED TRANSAMINASE BIOCATALYSTS AND METHODS FOR SYNTHESIZING CHIRAL AMINES

(71) Applicant: Codexis, Inc., Redwood City, CA (US)

(72) Inventors: Santhosh Sivaramakrishnan, Redwood City, CA (US); Ericka Bermudez, Aptos, CA (US); Nandhitha Subramanian, Cambridge (GB); David Entwistle, San Carlos, CA (US); Stephanie Marie Forget, Redwood City, CA (US)

(73) Assignee: Codexis, Inc., Redwood City, CA (US)

( * ) Notice: Subject to any disclaimer, the term of this patent is extended or adjusted under 35 U.S.C. 154(b) by 515 days.

(21) Appl. No.: 18/024,942

(22) PCT Filed: Sep. 17, 2021

(86) PCT No.: PCT/US2021/050944
§ 371 (c)(1),
(2) Date: Mar. 6, 2023

(87) PCT Pub. No.: WO2022/066534
PCT Pub. Date: Mar. 31, 2022

(65) Prior Publication Data

US 2024/0026401 A1 Jan. 25, 2024

Related U.S. Application Data

(60) Provisional application No. 63/084,166, filed on Sep. 28, 2020.

(51) Int. Cl.
*C12P 17/18* (2006.01)
*C12N 9/10* (2006.01)

(52) U.S. Cl.
CPC .......... *C12P 17/182* (2013.01); *C12N 9/1096* (2013.01); *C12Y 206/01018* (2013.01)

(58) Field of Classification Search
None
See application file for complete search history.

(56) References Cited

U.S. PATENT DOCUMENTS 4,518,692 A 5/1985 Rozzell
4,600,692 A 7/1986 Wood et al.
4,826,766 A 5/1989 Rozzell
4,950,606 A 8/1990 Stirling et al.
5,169,780 A 12/1992 Stirling et al.
5,300,437 A 4/1994 Stirling et al.
5,316,943 A 5/1994 Kidman et al.
5,605,793 A 2/1997 Stemmer
5,811,238 A 9/1998 Stemmer et al.
5,830,721 A 11/1998 Stemmer et al.
5,834,252 A 11/1998 Stemmer et al.
5,837,458 A 11/1998 Minshull et al.
5,928,905 A 7/1999 Stemmer et al.
6,096,548 A 8/2000 Stemmer
6,117,679 A 9/2000 Stemmer
6,132,970 A 10/2000 Stemmer
6,165,793 A 12/2000 Stemmer
6,180,406 B1 1/2001 Stemmer
6,197,558 B1 3/2001 Fotheringham
6,251,674 B1 6/2001 Tobin et al.
6,265,201 B1 7/2001 Wackett et al.
6,277,638 B1 8/2001 Stemmer
6,287,861 B1 9/2001 Stemmer et al.
6,287,862 B1 9/2001 Delcardayre et al.
6,291,242 B1 9/2001 Stemmer
6,297,053 B1 10/2001 Stemmer
6,303,344 B1 10/2001 Patten et al.
6,309,883 B1 10/2001 Minshull et al.
6,319,713 B1 11/2001 Patten et al.
6,319,714 B1 11/2001 Crameri et al.
6,323,030 B1 11/2001 Stemmer
6,326,204 B1 12/2001 Delcardayre et al.
6,335,160 B1 1/2002 Patten et al.
6,335,198 B1 1/2002 Delcardayre et al.
6,337,186 B1 1/2002 Krebber
6,344,356 B1 2/2002 Stemmer
6,352,859 B1 3/2002 Delcardayre et al.
6,355,484 B1 3/2002 Patten et al.
6,358,740 B1 3/2002 Patten et al.
6,358,742 B1 3/2002 Stemmer
(Continued)

FOREIGN PATENT DOCUMENTS

WO 95/22625 A1 8/1995
WO 95/33836 A1 12/1995
(Continued)

OTHER PUBLICATIONS

Chica et al. Curr Opin Biotechnol. Aug. 2005;16(4):378-84. (Year: 2005).*
Singh et al. Curr Protein Pept Sci. 2017, 18, 1-11 (Year: 2017).*
Bornscheuer et al. Curr Protoc Protein Sci. Nov. 2011;Chapter 26:Unit26.7. (Year: 2011).*
Yoshikuni et al. Curr Opin Chem Biol. Apr. 2007;11(2):233-9. (Year: 2007).*
Pavlidis, I.V., et al., "Identification of (S)-selective transaminases for the asymmetric synthesis of bulky chiral amines", Nature Chemistry, 8(11): 1076-1082 [2016].
Midelfort, K.S., et al., "Redesigning and characterizing the substrate specificity and activity of Vibrio fluvialis aminotransferase for the synthesis of imagabalin," Protein Eng Des Sel, 26(1):25-33 [2013].
Geneseq Accession No. AZQ80534, "ATP-dependent DNA helicase [*Escherichia coli*]", dated Dec. 26, 2018.
(Continued)

*Primary Examiner* — Christian L Fronda
(74) *Attorney, Agent, or Firm* — FisherBroyles, LLP; Adam K. Whiting; Adelaide K. Leitzel

(57) ABSTRACT

The present disclosure provides engineered transaminase polypeptides for the production of amines, polynucleotides encoding the engineered transaminases, host cells capable of expressing the engineered transaminases, and methods of using the engineered transaminases to prepare compounds useful in the production of active pharmaceutical agents.

9 Claims, No Drawings

Specification includes a Sequence Listing.

(56) References Cited

U.S. PATENT DOCUMENTS

| | | | |
|---|---|---|---|
| 6,365,377 | B1 | 4/2002 | Patten et al. |
| 6,365,408 | B1 | 4/2002 | Stemmer |
| 6,368,861 | B1 | 4/2002 | Crameri et al. |
| 6,372,497 | B1 | 4/2002 | Stemmer |
| 6,376,246 | B1 | 4/2002 | Crameri et al. |
| 6,379,964 | B1 | 4/2002 | Del Cardayre et al. |
| 6,387,702 | B1 | 5/2002 | Stemmer |
| 6,391,552 | B2 | 5/2002 | Stemmer |
| 6,391,640 | B1 | 5/2002 | Minshull et al. |
| 6,395,547 | B1 | 5/2002 | Stemmer |
| 6,406,855 | B1 | 6/2002 | Patten et al. |
| 6,406,910 | B1 | 6/2002 | Patten et al. |
| 6,413,745 | B1 | 7/2002 | Patten et al. |
| 6,413,774 | B1 | 7/2002 | Stemmer et al. |
| 6,420,175 | B1 | 7/2002 | Stemmer |
| 6,423,542 | B1 | 7/2002 | Crameri et al. |
| 6,426,224 | B1 | 7/2002 | Crameri et al. |
| 6,436,675 | B1 | 8/2002 | Welch et al. |
| 6,444,468 | B1 | 9/2002 | Stemmer et al. |
| 6,455,253 | B1 | 9/2002 | Patten et al. |
| 6,479,652 | B1 | 11/2002 | Crameri et al. |
| 6,482,647 | B1 | 11/2002 | Stemmer |
| 6,483,011 | B1 | 11/2002 | Stemmer et al. |
| 6,484,105 | B2 | 11/2002 | Zhang |
| 6,489,146 | B2 | 12/2002 | Stemmer et al. |
| 6,500,617 | B1 | 12/2002 | Stemmer et al. |
| 6,500,639 | B2 | 12/2002 | Subramanian |
| 6,506,602 | B1 | 1/2003 | Stemmer |
| 6,506,603 | B1 | 1/2003 | Stemmer |
| 6,518,065 | B1 | 2/2003 | Stemmer |
| 6,519,065 | B1 | 2/2003 | Colbourne et al. |
| 6,521,453 | B1 | 2/2003 | Crameri et al. |
| 6,528,311 | B1 | 3/2003 | Delcardayre et al. |
| 6,537,746 | B2 | 3/2003 | Arnold et al. |
| 6,573,098 | B1 | 6/2003 | Stemmer |
| 6,576,467 | B1 | 6/2003 | Stemmer |
| 6,579,678 | B1 | 6/2003 | Patten et al. |
| 6,586,182 | B1 | 7/2003 | Patten et al. |
| 6,602,986 | B1 | 8/2003 | Stemmer et al. |
| 6,605,430 | B1 | 8/2003 | Affholter et al. |
| 6,613,514 | B2 | 9/2003 | Patten et al. |
| 6,653,072 | B1 | 11/2003 | Patten et al. |
| 6,686,515 | B1 | 2/2004 | Lassner et al. |
| 6,703,240 | B1 | 3/2004 | Stemmer et al. |
| 6,716,631 | B1 | 4/2004 | Delcardayre et al. |
| 6,825,001 | B2 | 11/2004 | Wackett et al. |
| 6,902,922 | B2 | 6/2005 | Ness et al. |
| 6,917,882 | B2 | 7/2005 | Selifonov et al. |
| 6,946,296 | B2 | 9/2005 | Patten et al. |
| 6,961,664 | B2 | 11/2005 | Selifonov et al. |
| 6,995,017 | B1 | 2/2006 | Stemmer |
| 7,024,312 | B1 | 4/2006 | Selifonov et al. |
| 7,058,515 | B1 | 6/2006 | Selifonov et al. |
| 7,105,297 | B2 | 9/2006 | Minshull et al. |
| 7,148,054 | B2 | 12/2006 | Delcardayre et al. |
| 7,220,566 | B2 | 5/2007 | Ness et al. |
| 7,288,375 | B2 | 10/2007 | Stemmer et al. |
| 7,384,387 | B1 | 6/2008 | Raillard et al. |
| 7,421,347 | B2 | 9/2008 | Selifonov et al. |
| 7,430,477 | B2 | 9/2008 | Selifonov et al. |
| 7,462,469 | B2 | 12/2008 | Bass et al. |
| 7,534,564 | B2 | 5/2009 | Patten et al. |
| 7,620,500 | B2 | 11/2009 | Mundorff et al. |
| 7,620,502 | B2 | 11/2009 | Selifonov et al. |
| 7,629,170 | B2 | 12/2009 | Delcardayre et al. |
| 7,702,464 | B1 | 4/2010 | Emig et al. |
| 7,747,391 | B2 | 6/2010 | Gustafsson et al. |
| 7,747,393 | B2 | 6/2010 | Fox |
| 7,751,986 | B2 | 7/2010 | Gustafsson et al. |
| 7,776,598 | B2 | 8/2010 | Patten et al. |
| 7,783,428 | B2 | 8/2010 | Gustafsson et al. |
| 7,795,030 | B2 | 9/2010 | Minshull et al. |
| 7,853,410 | B2 | 12/2010 | Selifonov et al. |
| 7,868,138 | B2 | 1/2011 | Stemmer et al. |
| 7,873,477 | B1 | 1/2011 | Gustafsson et al. |
| 7,873,499 | B2 | 1/2011 | Selifonov et al. |
| 7,904,249 | B2 | 3/2011 | Selifonov et al. |
| 7,957,912 | B2 | 6/2011 | Selifonov et al. |
| 7,981,614 | B2 | 7/2011 | Stemmer et al. |
| 8,014,961 | B2 | 9/2011 | Bass et al. |
| 8,029,988 | B2 | 10/2011 | Crameri et al. |
| 8,048,674 | B2 | 11/2011 | Minshull et al. |
| 8,058,001 | B2 | 11/2011 | Crameri et al. |
| 8,076,138 | B2 | 12/2011 | Delcardayre et al. |
| 8,108,150 | B2 | 1/2012 | Mundorff et al. |
| 8,170,806 | B2 | 5/2012 | Selifonov et al. |
| 8,224,580 | B2 | 7/2012 | Mundorff et al. |
| 8,377,681 | B2 | 2/2013 | Delcardayre et al. |
| 8,383,346 | B2 | 2/2013 | Colbeck et al. |
| 8,457,903 | B1 | 6/2013 | Emig et al. |
| 8,470,564 | B2 | 6/2013 | Dhawan et al. |
| 8,504,498 | B2 | 8/2013 | Fox |
| 8,589,085 | B2 | 11/2013 | Selifonov et al. |
| 8,762,066 | B2 | 6/2014 | Fox |
| 8,768,871 | B2 | 7/2014 | Fox |
| 8,852,900 | B2 | 10/2014 | Cabirol et al. |
| 8,932,838 | B2 | 1/2015 | Cabirol et al. |
| 9,029,106 | B2 | 5/2015 | Dhawan et al. |
| 9,139,821 | B2 * | 9/2015 | Nazor ..................... C12P 17/10 |
| 9,228,223 | B2 | 1/2016 | Mundorff et al. |
| 9,388,395 | B2 * | 7/2016 | Nazor ..................... C12P 17/10 |
| 9,512,410 | B2 | 12/2016 | Dhawan et al. |
| 9,593,326 | B2 | 3/2017 | Clark et al. |
| 9,708,588 | B2 * | 7/2017 | Nazor .................. C12N 9/1096 |
| 9,944,909 | B2 | 4/2018 | Dhawan et al. |
| 10,323,233 | B2 | 6/2019 | Dhawan et al. |
| 10,544,402 | B2 * | 1/2020 | Nazor .................. C12N 9/1096 |
| 10,550,370 | B2 | 2/2020 | Dhawan et al. |
| 11,098,291 | B2 * | 8/2021 | Nazor ..................... C12P 17/10 |
| 12,378,537 | B2 * | 8/2025 | Nazor ..................... C12P 17/10 |
| 2006/0195947 | A1 | 8/2006 | Davis et al. |
| 2008/0213845 | A1 | 9/2008 | Fotheringham et al. |
| 2008/0220990 | A1 | 9/2008 | Fox |
| 2009/0312196 | A1 | 12/2009 | Colbeck et al. |
| 2012/0264739 | A1 | 10/2012 | Su et al. |
| 2013/0172341 | A1 | 7/2013 | Shipps, Jr. et al. |
| 2015/0045562 | A1 * | 2/2015 | Crowe ................ C07D 405/06 548/485 |
| 2015/0072383 | A1 * | 3/2015 | Nazor ..................... C12P 17/10 435/174 |
| 2020/0109378 | A1 | 4/2020 | Novick et al. |

FOREIGN PATENT DOCUMENTS

| | | | |
|---|---|---|---|
| WO | 96/00787 | A1 | 1/1996 |
| WO | 97/00078 | A1 | 1/1997 |
| WO | 97/35966 | A1 | 10/1997 |
| WO | 98/27230 | A1 | 6/1998 |
| WO | 00/42561 | A2 | 7/2000 |
| WO | 01/75767 | A2 | 10/2001 |
| WO | 2005/005633 | A2 | 1/2005 |
| WO | 2008/127646 | A2 | 10/2008 |
| WO | 2009/152336 | A1 | 12/2009 |
| WO | 2010/144103 | A1 | 12/2010 |
| WO | 2011/017551 | A1 | 2/2011 |
| WO | 2020/053198 | A1 | 3/2020 |

OTHER PUBLICATIONS

Altschul et al., "Basic local alignment search tool," J. Mol. Biol., 215: 403-410 [1990].

Altschul et al.,"Gapped BLAST and PSI-BLAST: a new generation of protein database search programs," Nucleic Acids Res.,25,17, 3389-3402 [1977].

Baldino et al., "High-resolution in situ hybridization histochemistry," Meth. Enzymol., 168:761-777 [1989].

Beaucage et al., "Deoxynucleoside Phosphoramidite—A New Class of Key Intermediates for Deoxypolynucleotide Synthesis," Tetrahedron Letters 22: 1859-69, 1981.

Bolton et al., "A General Method for the Isolation of RNA Complementary to DNA," Proc. Natl. Acad. Sci. USA 48,8:1390-1397 [1962].

(56) References Cited

OTHER PUBLICATIONS

Botstein et al., "Strategies and applications of in vitro mutagenesis," Science, 229, 4719:1193-1201 [1985].
Breslauer et al., "Predicting DNA duplex stability from the base sequence," Proc. Natl. Acad. Sci. USA, 83:3746-3750 [1986].
Carter, "Site-directed mutagenesis," Biochem. J., 237,1:1-7 [1986].
Cho et al., "Redesigning the Substrate Specificityof v-Aminotransferase for the KineticResolution of Aliphatic Chiral Amines," Biotechnol Bioeng. 99(2):275-84, 2008.
Christians et al., "Directed evolution of thymidine kinase for AZT phosphorylation using DNA family shuffling," Nat. Biotechnol., 17,3:259-264 [1999].
Crameri et al., "DNA shuffling of a family of genes from diverse species accelerates directed evolution," Nature, 391:288-291 [1998].
Crameri et al., "Improved Green Fluorescent Protein by Molecular Evolution Using DNA Shuffling," Nat. Biotechnol., 14:315-319 [1996].
Crameri et al., "Molecular evolution of an arsenate detoxification pathway by DNA shuffling," Nat. Biotechnol., 15:436-438 [1997].
Dale et al., "Oligonucleotide-Directed Random Mutagenesis Using the Phosphorothioate Method," Meth. Mol. Biol.,57:369-374 [1996].
DeBoer et al., "The tac promoter: a functional hybrid derived from the trp and lac promoters," Proc. Natl Acad. Sci. USA,80: 21-25, [1983].
Freier et al., "Improved free-energy parameters for predictions of RNA duplex stability," Proc. Natl. Acad. Sci. USA 83,24:9373-9377 [1986].
GenBank Acc. No. ABA47738.1, GI:76578263; dated Jan. 31, 2014.
GenBank Acc. No. AEA39183.1, GI:327207066; dated Apr. 4, 2011.
GenBank Acc. No. AM902716.1, GI:163258032; dated Feb. 27, 2015.
GenBank Acc. No. YP_002257813.1, GI:207739420; dated Dec. 16, 2010.
Guo et al., "3'-End-Forming Signals of Yeast mRNA," Mol. Cell. Biol., 15, 11:5983-5990 [1995].
Henaut et al., "Analysis and Predictions from *Escherichia coli* Sequences, or *E. coli* in Silico," in *Escherichia coli* and *Salmonella*, Neidhardt, et al. (eds.), ASM Press, Washington D.C.,p. 2047-2066 [1996].
Henikoff et al., "Amino acid substitution matrices from protein blocks," Proc. Natl. Acad. Sci. USA 89, 22:10915 [1989].
Höhne et al., "Biocatalytic Routes to Optically Active Amines," Chem Cat Chem 1(1):42-51.
Höhne et al., "Efficient Asymmetric Synthesis of Chiral Amines by Combining Transaminase and Pyruvate Decarboxylase," ChemBioChem, 9:363-365, 2008.
Hwang et al., "High-throughput screening method for the identification of active and enantioselective ω-transaminases," Enzyme and Microbial Technology, 34:429-436, 2004.
Introduction to Organic Chemistry,2d ed., Andrew Streitwieser and Clayton Heathcock (1981), pp. 169-171.
Iwasaki et al., "Microbial synthesis of chiral amines by (R)-specific transamination with *Arthrobacter* sp. KNK168," Appl. Microb. Biotech.69:499-505, 2004.
Iwasaki et al., "Microbial synthesis of (R)- and (S)-3,4-dimethoxyamphetamines throughstereoselective transamination," Biotech. Lett. 25:1843-1846; 2003.
Wetmur, J.G., "DNA Probes: Applications of the Principles of Nucleic Acid Hybridization," Rev. Biochem. Mol. Biol. 26:227-259 [1991].
Kierzek et al., "Polymer-supported RNA synthesis and its application to test the nearest-neighbor model for duplex stability," Biochem., 25,24:7840-7846 [1986].
Koszelewski et al., "Asymmetric Synthesis of Optically Pure Pharmacologically Relevant Amines Employing ω-Transaminases," Adv. Syn. Catal. 350:2761-2766, 2008.
Koszelewski et al., "Deracemization of Mexiletine Biocatalyzed by ω-Transaminases," Org Lett. 11(21):4810-4812, 2009.
Koszelewski et al., "Immobilization of ω-transaminases by encapsulation in a sol-gel/celite matrix,"J. Mol. Cat. B: Enzymatic, 63: 39-44 [2010].
Kramer et al., "Different base/base mismatches are corrected with different efficiencies by the methyl-directed DNA mismatch-repair system of *E. coli*," Cell, 38,3:879-887 [1984].
Ling et al., "Approaches to DNA Mutagenesis: An Overview," Anal. Biochem., 254(2):157-178 [1997].
Martin et al., "Characterization of free and immobilized(S)-aminotransferase for acetophenone production," Appl. Microbiol. Biotechnol., 76(4): 843-851[2007].
Mateo et al., "Epoxy sepabeads: a novel epoxy support for stabilization of industrial enzymes via very intense multipoint covalent attachment," Biotechnol. Prog., 18(3):629-34 [2002].
Matthes et al., "Simultaneous rapid chemical synthesis of over one hundred oligonucleotides on a microscale," EMBO J., 3(4):801-05 (1984).
McInerney, "GCUA: General Codon Usage Analysis," Bioinformatics, 14(4), 372-373 [1998].
Midelfort, KS et al., Chain A, Pyruvate transaminase. PDB: 4E3R_A. NCBI entry (online). National Center for Biotechnology Information. Jan. 2, 2013 [retrieved on Jan. 25, 2022]. Retrieved from the Internet URL:https://www.ncbi.nlm.nih.gov/protein/4E3R_A?report=genban&klog$=protalign&blast_rank=4&RID=Z1D1VWP4016; pp. 1, 3.
Minshull et al., "Protein evolution by molecular breeding," Curr. Op. Chem. Biol., 3,3:284-290 [1999].
Mount, Bioinformatics: Sequence and Genome Analysis, Chapter 8, Cold Spring Harbor Laboratory Press, Cold Spring Harbor, N.Y. [2001].
Nakamura et al., "Codon usage tabulated from international DNA sequence databases: status for the year 2000," Nucl. Acids Res., 28,1:292[2000].
Needleman et al., "A general method applicable to the search for similarities in the amino acid sequence of two proteins," J. Mol. Biol., 48:443-453 [1970].
Organic Chemistry, 2d ed., Francis Carey (1992), pp. 328-331.
Organic Chemistry, 5th Ed., John McMurry, Brooks/Cole Publishing (2000), pp. 398 and 408.
Pearson et al., "Improved tools for biological sequence comparison," Proc. Natl. Acad. Sci. USA 85:2444-2448 [1988].
Romanos et al., "Foreign Gene Expression in Yeast: a Review," Yeast 8:423-488 [1992].
Rychlik et al., "Optimization of the annealing temperature for DNA amplification in vitro," [published erratum appears in Nucleic Acids Res 1991;19:698]. Nucleic Acids Res., 8:6409-6412 [1990].
Savolitinib, BioVision, dated Mar. 2020.
Shin et al., "Comparison of the ω-Transaminases from Different Microorganisms and Application to Production of Chiral Amines," Biosci. Biotechnol, Biochem. 65:1782-1788, 2001.
Shin et al., "Exploring the Active Site of Amine: Pyruvate Aminotransferase on the Basis of the Substrate Structure-Reactivity Relationship: How the Enzyme Controls Substrate Specificity and Stereoselectivity," J. Org. Chem. 67:2848-2853, 2002.
Shin et al., "Kinetic resolution of chiral amines with ω-transaminase using an enzyme-membrane reactor," Biotechnol Bioeng 73:179-187, 2001.
Shin et al., "Purification, characterization, and molecular cloning of a novel amine:pyruvate transaminase from Vibrio fluvialis JS17," Appl. Microbiol. Biotechnol. 61(5-6):463-471, 2003.
Shin J et al., "Asymmetric synthesis of chiral amines with ω-transaminase," Biotechnol. Bioeng. 65, 206-211, 1999.
Shin J et al., "Kinetic resolution of α-methylbenzylamine with o-transaminase screened from soil microorganisms: Application of a biphasic system to overcome product inhibition," Biotechnol. Bioeng. 55:348-358, 1997.
Simonen et al., "Protein secretion in Bacillus species," Microbiol. Rev., 57:109-137, 1993.
Smith et al., "Comparison of biosequences," Adv. Appl. Math., 2:482-489 [1981].
Smith M., "In Vitro Mutagenesis," Annual Review of Genetics, 19(1), 423-462 [1985].

(56) References Cited

OTHER PUBLICATIONS

Stemmer, "DNA shuffling by random fragmentation and reassembly: In vitro recombination for molecular evolution," Proc. Natl. Acad. Sci. USA 91:10747-10751 [1994].

Stemmer, "Rapid evolution of a protein in vitro by DNA shuffling," Nature, 370:389-391 [1994].

Stenico et al., "Codon usage in Caenorhabditis elegans: delineation of translational selection and mutational biases," Nucleic Acids Research, 22(13), 2437-2446 [1994].

Suggs et al., "In: Brown DD (ed) ICN-UCLA 23rd Symposium on Developmental Biology using Purified Genes," pp. 683-693. Academic Press, New York [1981].

Fasman, 1989, CRC Practical Handbook of Biochemistry and Molecular Biology, CRC Press, Boca Raton, FL, at pp. 3-70.

Tiwari et al., "Prediction of probable genes by Fourier analysis of genomic sequences," Comput. Appl. Biosci., 13:263-270 [1997].

Truppo et al., "Development of an Improved Immobilized CAL-B for the Enzymatic Resolution of a Key Intermediate to Odanacatib," Org. Proc. Res. Dev., 2011, 15, 1033-1035.

Uberbacher et al., "Discovering and understanding genes in human DNA sequence using GRAIL," Meth. Enzymol., 266:259-281 [1996].

Van Ophem et al., "Substrate Inhibition of D-Amino Acid Transaminase and Protection by Salts and by Reduced Nicotinamide Adenine Dinucleotide: Isolation and Initial Characterization of a Pyridoxo Intermediate Related to Inactivation," Biochemistry 37(9):2879-88, 1988.

Villa-Komaroff L et al., "A bacterial clone synthesizing proinsulin," Proceedings of the National Academy of Sciences, 75(8), 3727-3731, 1978.

Wada et al., "Codon usage tabulated from the GenBank genetic sequence data," Nucl. Acids Res., 20:2111-2118 [1992].

Wells et al., "Cassette mutagenesis: an efficient method for generation of multiple mutations at defined sites," Gene, 34,2-3:315-323 [1985].

Wright, "The 'effective number of codons' used in a gene," Gene, 87,1:23-29 [1990].

Yi et al.,"Covalent immobilization of v-transaminase from Vibrio fluvialis JS17 on chitosan beads," Proc. Biochem., 42(5): 895-898 [2007].

Yonaha et al., "Distribution of ω-Amino Acid: Pyruvate Transaminase and Aminobutyrate: α-Ketoglutarate Transaminase in Microorganisms ," Agric.Biol. Chem. 47 (10):2257-2265, 1983.

Yun et al., "ω-Amino Acid:Pyruvate Transaminase from Alcaligenes denitrificans Y2k-2: a New Catalyst for Kinetic Resolution of β-Amino Acids and Amines," Appl. Environ. Microbiol. 70:2529-2534, 2004.

Yun et al., "Kinetic resolution of (R,S)-sec-butylamine using omega-transaminase from Vibrio fluvialis JS17 under reduced pressure," Biotechnol. Bioeng. 87:772-778, 2004.

Yun et al., "Use of Enrichment Culture for Directed Evolution of the Vibrio fluvialis JS17 ω-Transaminase, Which Is Resistant to Product Inhibition by Aliphatic Ketones," Appl Environ Microbiol. 71(8):4220-4224, 2005.

Yun K., et al., "Asymmetric Synthesis of (S)-α-Methylbenzylamine by Recombinant *Escherichia coli* Co-Expressing Omega-Transaminase and Acetolactate Synthase," Biosci. Biotechnol. Biochem. 72(11):3030-3033, 2008.

Zhang et al., "Directed evolution of a fucosidase from a galactosidase by DNA shuffling and screening," Proc. Nat. Acad. Sci. U.S.A., 94,9:4504-4509 [1997].

Zhu et al., "Biocatalytic asymmetric amination of carbonyl functional groups—a synthetic biology approach to organic chemistry," Biotechnol J. 4(10):1420-31, [2009].

Batzer, M.A., "Erratum: Structure and variability of recently inserted Alu family members", Nucleic Acids Res 19:698-699 [1991].

* cited by examiner

ENGINEERED TRANSAMINASE BIOCATALYSTS AND METHODS FOR SYNTHESIZING CHIRAL AMINES

The present application is a national stage application filed under 35 USC § 371 and claims priority to PCT International Application No. PCT/US21/50944, filed Sep. 17, 2021, which claims priority to U.S. Prov. Pat. Appln. Ser. No. 63/084,166, filed Sep. 28, 2020, both of which are hereby incorporated by reference in their entirety for all purposes.

1. TECHNICAL FIELD

The disclosure relates to transaminase biocatalysts and processes using the biocatalysts for the preparation of chiral amines.

2. REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-212W01_ST25.txt", a creation date of Sep. 16, 2021, and a size of 984 kilobytes. The Sequence Listing filed via EFS-Web is part of the specification and is incorporated in its entirety by reference herein.

3. BACKGROUND

Transaminases (E.C. 2.6.1) catalyze the transfer of an amino group, a pair of electrons, and a proton from a primary amine of an amino donor substrate to the carbonyl group of an amino acceptor molecule as shown in Scheme 1.

Scheme 1

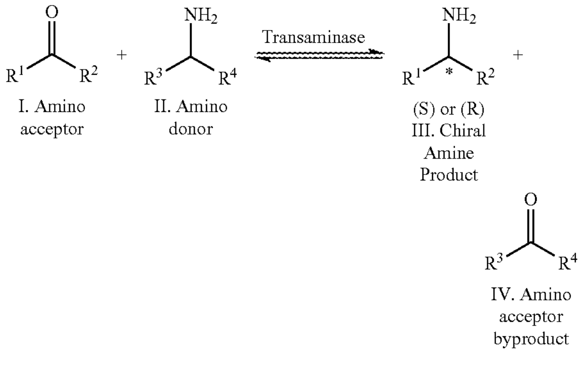

I. Amino acceptor

II. Amino donor (S) or (R) III. Chiral Amine Product

IV. Amino acceptor byproduct

An amino acceptor compound (I) (which is the precursor of the desired chiral amine product (III)) is reacted with an amino donor compound (II). The transaminase catalyzes the transfer of the amine group of the amino donor (II) to the keto group of the amino acceptor (I). The reaction results in the desired chiral amine product compound (III) and a new amino acceptor compound (IV) with a ketone group as a by-product.

Wild-type transaminases having the ability to catalyze a reaction of Scheme 1 have been isolated from various microorganisms, including, but not limited to, *Alcaligenes denitrificans, Bordetella bronchiseptica, Bordetella parapertussis, Brucella melitensis, Burkholderia malle, Burkholderia pseudomallei, Chromobacterium violaceum, Oceanicola granulosus* HTCC2516, *Oceanobacter* sp. RED65, *Oceanospirillum* sp. MED92, *Pseudomonas putida, Ralstonia solanacearum, Rhizobium meliloti, Rhizobium* sp. (strain NGR234), *Bacillus thuringensis, Klebsiella pneumonia*, and *Vibrio fluvialis* (see e.g., Shin et al., 2001, Biosci. Biotechnol, Biochem. 65:1782-1788). Several of these wild-type transaminase genes and encoded polypeptides have been sequenced, including e.g., *Ralstonia solanacearum* (Genbank Acc. No. YP_002257813.1, GI:207739420), *Burkholderia pseudomallei* 1710b (Genbank Acc. No. ABA47738.1, GI:76578263), *Bordetella petrii* (Genbank Acc. No. AM902716.1, GI:163258032), and *Vibrio fluvialis* (Genbank Acc. No. AEA39183.1, GI: 327207066). Two wild-type transaminases of classes EC 2.6.1.18 and EC 2.6.1-19, have been crystallized and structurally characterized (see e.g., Yonaha et al., 1983, Agric. Biol. Chem. 47 (10):2257-2265).

The wild-type transaminase from *Vibrio fluvialis* JS17 is an ω-amino acid:pyruvate transaminase (E.C. 2.6.1.18) that uses pyridoxal-5'-phosphate as cofactor to catalyze the reaction of Scheme 2.

Scheme 2

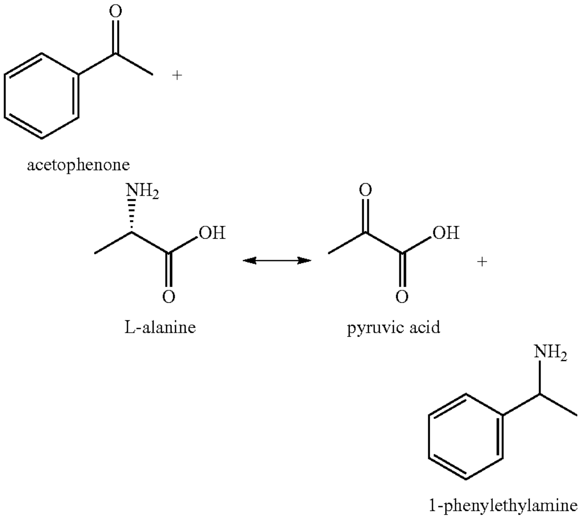

acetophenone

L-alanine pyruvic acid 1-phenylethylamine

This wild-type transaminase from *Vibrio fluvialis* also has been reported to show catalytic activity toward aliphatic amino donors that do not have a carboxyl group.

Chiral amine compounds are frequently used in the pharmaceutical, agrochemical and chemical industries as intermediates or synthons for the preparation of various pharmaceuticals, such as cephalosporine or pyrrolidine derivatives. A great number of these industrial applications of chiral amine compounds involve using only one particular optically active form, e.g., only the (R) or the (S) enantiomer is physiologically active. Transaminases have potential industrial use for the stereoselective synthesis of optically pure chiral amine compounds, such as in the enantiomeric enrichment of amino acids (see e.g., Shin et al., 2001, Biosci. Biotechnol. Biochem. 65:1782-1788; Iwasaki et al., 2003, Biotech. Lett. 25:1843-1846; Iwasaki et al., 2004, Appl. Microb. Biotech. 69:499-505, Yun et al., 2004, Appl. Environ. Microbiol. 70:2529-2534; and Hwang et al., 2004, Enzyme Microbiol. Technol. 34:429-426).

Other examples of the use of transaminases include the preparation of intermediates and precursors of pregabalin (e.g., WO 2008/127646); the enzymatic transamination of cyclopamine analogs (e.g., WO 2011/017551); the stereospecific synthesis and enantiomeric enrichment of 3-amino acids (e.g., WO 2005/005633); the enantiomeric enrichment of amines (e.g., U.S. Pat. Nos. 4,950,606; 5,300,437; and 5,169,780); and the production of amino acids and derivatives (e.g., U.S. Pat. Nos. 5,316,943; 4,518,692; 4,826,766; 6,197,558; and 4,600,692).

However, transaminases used to catalyze reactions for the preparation of chiral amine compounds can have properties that are undesirable for commercial applications, such as instability to industrially useful process conditions (e.g., solvent, temperature) and narrow substrate recognition. Thus, there is a need for other types of transaminase biocatalysts that can be used in industrial processes for preparing chiral amines compounds in an optically active form.

4. SUMMARY

The present disclosure provides engineered polypeptides having transaminase activity, polynucleotides encoding the polypeptides, methods of making the polypeptides, and methods of using the polypeptides for the biocatalytic conversion of ketone substrates to amine products. The polypeptides having transaminase activity of the present disclosure have been engineered to have one or more residue differences as compared to a previously engineered transaminase polypeptide (of amino acid sequence SEQ ID NO: 4) with enhanced activity and thermal stability relative to the wild-type transaminase of *Vibrio fluvialis* or relative to an engineered variant of the wild-type transaminase. The amino acid residue differences are located at residue positions affecting various enzyme properties, including among others, activity, stereoselectivity, stability, expression, product tolerance and substrate tolerance.

Savolinitib or 3-[(1S)-1-imidazo[1,2-a]pyridin-6-ylethyl]-5-(1-methylpyrazol-4-yl)triazolo[4,5-b]pyrazine (1) is a small molecule drug developed by Hutchison MediPharma Limited and AstraZeneca. It is a potent c-Met kinase inhibitor that is being tested in combination with osimertinib to treat patients with non-small cell lung cancer and advanced or metastatic papillary renal cell cancer (see Section 5.3, below).

The current chemical synthetic approach to produce compound (1) involves five steps, the first of which involves transamination of the substrate ketone, compound (2), to produce enantioselective amine product, compound (3) (WO2020/053198). An engineered (S)-selective aminotransaminase enzyme can be used for this conversion under industrial process conditions. While the selectivity was suitable, there is a need to improve the activity of the enzyme to accept higher substrate loads to optimize industrial production. This disclosure provides engineered S-selective aminotransferase enzymes with improved activity and substrate tolerance.

In some embodiments, the present disclosure provides engineered transaminases comprising polypeptide sequences having at least 85%, 86%, 87%, 88%, 89%, 90%, 91%, 92%, 93%, 94%, 95%, 96%, 97%, 98%, 99%, or more sequence identity to SEQ ID NOS: 4 and/or 6, or a functional fragment thereof, wherein said engineered transaminases comprise at least one substitution or substitution set in said polypeptide sequences, and wherein the amino acid positions of said polypeptide sequences are numbered with reference to SEQ ID NO: 4, and/or 6. In some embodiments, the engineered transaminase comprises a polypeptide sequence comprising at least 85%, 86%, 87%, 88%, 89%, 90%, 91%, 92%, 93%, 94%, 95%, 96%, 97%, 98%, 99%, or more sequence identity to SEQ ID NO: 4, wherein said engineered transaminase comprises at least one substitution or substitution set in said polypeptide sequence at one or more positions selected from 13, 41/57/130/415/419, 41/113/415, 53/57, 88, 88/89, 97/415, 148, 227, 260, 302, 355/415/419, 362, 417, and 443, and wherein the amino acid positions of said polypeptide sequence are numbered with reference to SEQ ID NO: 4. In some additional embodiments, the engineered transaminase comprises a polypeptide sequence comprising at least 85%, 86%, 87%, 88%, 89%, 90%, 91%, 92%, 93%, 94%, 95%, 96%, 97%, 98%, 99%, or more sequence identity to SEQ ID NO: 6, wherein said engineered transaminase comprises at least one substitution or substitution set in said polypeptide sequence at one or more positions selected from 13, 13/41/57/88/130/415/417, 13/41/57/89/97/417, 13/41/57/97/130/415/417, 13/41/57/97/130/415/417/443, 13/41/57/97/443, 13/41/57/130/417, 13/41/57/417, 13/41/88, 13/41/88/89, 13/41/88/89/97/415/443, 13/41/88/89/417, 13/41/88/97, 13/41/88/130/415/443, 13/41/88/443, 13/41/89/130/148/443, 13/41/89/417, 13/41/89/443, 13/41/97/130/417, 13/41/97/415, 13/41/97/415/417, 13/41/97/417, 13/41/97/417/443, 13/41/130/415/443, 13/41/415, 13/41/415/417, 13/41/415/443, 13/41/417, 13/41/417/443, 13/57/88/89/130/415/443, 13/57/88/97, 13/57/88/97/415/443, 13/57/88/130/415, 13/57/88/130/417/443, 13/57/88/415, 13/57/97/130/415/417/443, 13/57/97/417, 13/88/89/415/417, 13/88/89/415/417/443, 13/88/130/443, 13/88/415, 13/89/97/415/417, 13/89/97/417, 13/89/417, 13/97/148/415, 13/97/415, 13/97/415/417, 13/97/417, 13/130/415, 13/130/415/417, 13/130/417, 13/130/417/443, 13/415, 13/415/417, 13/415/417/443, 13/415/443, 13/417, 13/417/443, 13/443, 23/53/162/233/277/315/415/418/432, 23/53/315/417/418, 23/277/315/395/415/417/432, 23/277/395/417/418, 23/395/418, 23/418, 41, 41/57/88, 41/57/88/415/443, 41/57/130/148/415/417, 41/57/130/443, 41/57/415/417, 41/88/89/97/130/415, 41/88/89/415/417, 41/88/97/130/417, 41/88/130/415/417, 41/88/443, 41/97/130/148/415/417/443, 41/97/417, 41/97/417/443, 41/130/415, 41/130/415/417/443, 41/130/415/443, 41/415/443, 41/417, 41/417/443, 53/162, 53/162/395/417, 53/162/418/432, 53/233, 53/277/395, 53/277/395/417/418, 53/277/415/417, 57/88/97/130/415/443, 57/88/97/130/417, 57/88/97/417, 57/97/130/148/417/443, 57/417, 88, 88/89/130/417, 88/97/415/417/443, 88/130/417/443, 88/148/417/443, 88/415, 88/415/417, 88/415/417/443, 88/417, 89/97/415/417, 89/97/417, 89/443, 97, 97/130, 97/148/415, 97/415, 97/415/417, 97/417, 130, 130/415, 130/417, 130/443, 162/233/415/417, 162/395/415/417, 162/418, 233/315/415/417, 233/315/417, 277/395/415/418/432, 315, 315/415/418/432, 395/418, 415, 415/417, 415/417/418, 415/417/418/432, 415/417/443, 415/443, 417, and 443, and wherein the amino acid positions of said polypeptide sequence are numbered with reference to SEQ ID NO: 6.

In some further embodiments, the engineered transaminase comprises a polypeptide sequence comprising at least 85%, 86%, 87%, 88%, 89%, 90%, 91%, 92%, 93%, 94%, 95%, 96%, 97%, 98%, 99%, or more, identical to the sequence of at least one engineered transaminase variant set forth in Table 5.1 and/or 6.1. In yet some additional embodiments, the engineered transaminase is a variant engineered transaminase provided in Table 5.1 and/or 6.1. In some further embodiments, the engineered transaminase comprises a polypeptide sequence that is at least 85%, 86%, 87%, 88%, 89%, 90%, 91%, 92%, 93%, 94%, 95%, 96%, 97%, 98%, 99% or more identical to the sequence of at least one engineered transaminase variant set forth in SEQ ID NOS: 4 and/or 6. In some additional embodiments, the engineered transaminase comprises a polypeptide sequence comprising SEQ ID NOS: 4 and/or 6. In some further embodiments, the engineered transaminase comprises a polypeptide sequence that is at least 85%, 86%, 87%, 88%, 89%, 90%, 91%, 92%, 93%, 94%, 95%, 96%, 97%, 98%, 99% or more identical to the sequence of at least one engineered transaminase variant set forth in the even numbered sequences of SEQ ID NOS: 6-358. In yet some additional embodiments, the engineered transaminase comprises a polypeptide sequence forth in the even numbered sequences of SEQ ID NOS: 6-358. In some further embodiments, the engineered transaminase comprises at least one improved property compared to wild-type *V. fluvialis* transaminase or compared to an engineered variant of the wild-type transaminase. In some additional embodiments, the improved property of the engineered transaminase comprises improved activity on a substrate. In some further embodiments, the substrate comprises compound (2). In some additional embodiments, the improved property of the engineered transaminase comprises improved substrate tolerance. In yet some additional embodiments, the improved property of the engineered transaminase comprises improved thermostability. In some additional embodiments, the engineered transaminase is purified. The present disclosure also provides compositions comprising an engineered transaminase provided herein. In some embodiments, the compositions comprise more than one engineered transaminase provided herein.

The present disclosure also provides polynucleotide sequences encoding at least one engineered transaminase provided herein. In some embodiments, the polynucleotide sequence encodes at least one engineered transaminase, said polynucleotide sequence comprising at least 85%, 86%, 87%, 88%, 89%, 90%, 91%, 92%, 93%, 94%, 95%, 96%, 97%, 98%, 99%, or more sequence identity to SEQ ID NOS: 3 and/or 5, wherein the polynucleotide sequence of said engineered transaminase comprises at least one substitution at one or more positions. In some further embodiments, the polynucleotide sequence encodes at least one engineered transaminase comprising at least 85%, 86%, 87%, 88%, 89%, 90%, 91%, 92%, 93%, 94%, 95%, 96%, 97%, 98%, 99%, or more sequence identity to SEQ ID NOS: 3 and/or 5, or a functional fragment thereof. In yet some additional embodiments, the polynucleotide sequence is operably linked to a control sequence. In still some further embodiments, the polynucleotide sequence is codon optimized.

The present disclosure also provides expression vectors comprising at least one polynucleotide sequence encoding an engineered transaminase provided herein. In some embodiments, the expression vector comprises at least one polynucleotide sequence comprising at least 85%, 86%, 87%, 88%, 89%, 90%, 91%, 92%, 93%, 94%, 95%, 96%, 97%, 98%, 99%, or more sequence identity to SEQ ID NOS: 3 and/or 5, wherein the polynucleotide sequence of said engineered transaminase comprises at least one substitution at one or more positions. In some embodiments, the expression vector comprises a polynucleotide sequence encoding at least one engineered transaminase comprising at least 85%, 86%, 87%, 88%, 89%, 90%, 91%, 92%, 93%, 94%, 95%, 96%, 97%, 98%, 99%, or more sequence identity to SEQ ID NOS: 3 and/or 5, or a functional fragment thereof.

The present disclosure also provides host cells comprising at least one expression vector provided herein. In some embodiments, the host cell comprises at least one polynucleotide sequence provided herein. In some embodiments, the host cell comprises at least one polynucleotide sequence comprising at least 85%, 86%, 87%, 88%, 89%, 90%, 91%, 92%, 93%, 94%, 95%, 96%, 97%, 98%, 99%, or more sequence identity to SEQ ID NOS: 3 and/or 5, wherein the polynucleotide sequence encoding the engineered transaminase comprises at least one substitution at one or more positions. In some embodiments, the host cell comprises a polynucleotide sequence encoding at least one engineered transaminase comprising at least 85%, 86%, 87%, 88%, 89%, 90%, 91%, 92%, 93%, 94%, 95%, 96%, 97%, 98%, 99%, or more sequence identity to SEQ ID NOS: 4 and/or 6, or a functional fragment thereof. In some embodiments, at least one polynucleotide sequence encoding an engineered transaminase is present in at least one expression vector.

The present disclosure also provides methods of producing an engineered transaminase in a host cell, comprising culturing the host cell provided herein under suitable conditions, such that at least one engineered transaminase is produced. In some embodiments, the methods further comprise recovering at least one engineered transaminase from the culture and/or host cell. In some additional embodiments, the methods further comprise the step of purifying said at least one engineered transaminase.

In some embodiments, the engineered polypeptide having transaminase activity is immobilized on a solid support, optionally wherein the solid support is selected from a bead or resin comprising polymethacrylate with epoxide functional groups, polymethacrylate with amino epoxide functional groups, styrene/DVB copolymer or polymethacrylate with octadecyl functional groups.

In some embodiments, the engineered polypeptide having transaminase activity is capable of converting a substrate of compound (2) to a product of compound (3) under suitable reaction conditions (see Section 5.3, below). In some embodiments, the engineered polypeptide is capable of converting compound (2) to compound (3) with at least 1.2 fold, 2 fold, 5 fold, 10 fold, 20 fold, 25 fold, 50 fold, 75 fold, 100 fold, or greater than the activity of a reference sequence (e.g. SEQ ID NO: 4 and/or 6), under suitable reaction conditions. In some embodiments, the engineered polypeptide is capable of converting compound (2) to compound (3) with increased activity relative to a reference sequence (e.g., SEQ ID NO: 4 and/or 6), in which the suitable reaction conditions comprise compound (2) at a loading of at least 50 g/L, about 5 g/L engineered polypeptide, about 0.25 g/L PLP, about 1.8 M isopropylamine, about pH 10, and about 50° C.

Guidance on the choice of engineered transaminases, preparation of the biocatalysts, the choice of enzyme substrates, and parameters for carrying out the processes are further described in the detailed description that follow.

5. DETAILED DESCRIPTION

As used in this specification and the appended claims, the singular forms “a”, “an” and “the” include plural referents unless the context clearly indicates otherwise. Thus, for example, reference to “a polypeptide” includes more than one polypeptide.

Similarly, “comprise,” “comprises,” “comprising” “include,” “includes,” and “including” are interchangeable and not intended to be limiting.

It is to be further understood that where descriptions of various embodiments use the term “comprising,” those skilled in the art would understand that in some specific instances, an embodiment can be alternatively described using language "consisting essentially of" or "consisting of."

It is to be understood that both the foregoing general description, including the drawings, and the following detailed description are exemplary and explanatory only and are not restrictive of this disclosure.

The section headings used herein are for organizational purposes only and not to be construed as limiting the subject matter described.

5.1 Abbreviations

The abbreviations used for the genetically encoded amino acids are conventional and are as follows:

| Amino Acid | Three-Letter Abbreviation | One-Letter Abbreviation |
|---|---|---|
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | HIS | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleotides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

5.2 Definitions

In reference to the present disclosure, the technical and scientific terms used in the descriptions herein will have the meanings commonly understood by one of ordinary skill in the art, unless specifically defined otherwise. Accordingly, the following terms are intended to have the following meanings.

"Protein", "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids.

"Polynucleotide" or "nucleic acid' refers to two or more nucleosides that are covalently linked together. The polynucleotide may be wholly comprised ribonucleosides (i.e., an RNA), wholly comprised of 2'-deoxyribonucleotides (i.e., a DNA) or mixtures of ribo- and 2'-deoxyribonucleosides. While the nucleosides will typically be linked together via standard phosphodiester linkages, the polynucleotides may include one or more non-standard linkages. The polynucleotide may be single-stranded or double-stranded or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. Preferably, such modified or synthetic nucleobases will be encoding nucleobases.

"Aminotransferase" and "transaminase" are used interchangeably herein to refer to a polypeptide having an enzymatic capability of transferring an amino group ($NH_2$) from a primary amine to a carbonyl group (C═O) of an acceptor molecule. Transaminases as used herein include naturally occurring (wild-type) transaminases as well as non-naturally occurring engineered polypeptides generated by human manipulation.

"Amino acceptor" and "amine acceptor," "keto substrate," "keto," and "ketone" are used interchangeably herein to refer to a carbonyl (keto, or ketone) compound which accepts an amino group from a donor amine. In some embodiments, amino acceptors are molecules of the following general formula,

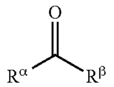

amino acceptor in which each of $R^\alpha$ and $R^\beta$, when taken independently, is an alkyl, cycloalkyl, heterocycloalkyl, aryl, or heteroaryl, which can be unsubstituted or substituted with one or more enzymatically acceptable groups. $R^\alpha$ may be the same or different from $R^\beta$ in structure or chirality. In some embodiments, $R^\alpha$ and $R^\beta$, taken together, may form a ring that is unsubstituted, substituted, or fused to other rings. Amino acceptors include keto carboxylic acids and alkanones (ketones). Typical keto carboxylic acids are α-keto carboxylic acids such as glyoxalic acid, pyruvic acid, oxaloacetic acid, and the like, as well as salts of these acids. Amino acceptors also include substances which are converted to an amino acceptor by other enzymes or whole cell processes, such as fumaric acid (which can be converted to oxaloacetic acid), glucose (which can be converted to pyruvate), lactate, maleic acid, and others. Amino acceptors that can be used include, by way of example and not limitation, 3,4-dihydronaphthalen-1(2H)-one, 1-phenylbutan-2-one, 3,3-dimethylbutan-2-one, octan-2-one, ethyl 3-oxobutanoate, 4-phenylbutan-2-one, 1-(4-bromophenyl)ethanone, 2-methylcyclohexamone, 7-methoxy-2-tetralone, 1-hydroxybutan-2-one, pyruvic acid, acetophenone, 3'-hydroxyacetophenone, 2-methoxy-5-fluoroacetophenone, levulinic acid, 1-phenylpropan-1-one, 1-(4-bromophenyl)propan-1-one, 1-(4-nitrophenyl)propan-1-one, 1-phenylpropan-2-one, 2-oxo-3-methylbutanoic acid, 1-(3-trifluoromethylphenyl)propan-1-one, hydroxypropanone, methoxyoxypropanone, 1-phenylbutan-1-one, 1-(2,5-dimethoxy-4-methylphenyl)butan-2-one, 1-(4-hydroxyphenyl)butan-3-one, 2-acetylnaphthalene, phenylpyruvic acid, 2-ketoglutaric acid, and 2-ketosuccinic acid, including both (R) and (S) single isomers where possible.

"Amino donor" or "amine donor" refers to an amino compound which donates an amino group to the amino acceptor, thereby becoming a carbonyl species. In some embodiments, amino donors are molecules of the following general formula,

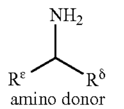

amino donor in which each of $R^{\varepsilon}$ and $R^{\delta}$, when taken independently, is an alkyl, cycloalkyl, heterocycloalkyl, aryl, or heteroaryl, which is unsubstituted or substituted with one or more enzymatically non-inhibiting groups. $R^{\varepsilon}$ can be the same or different from $R^{\delta}$ in structure or chirality. In some embodiments, $R^{\varepsilon}$ and $R^{\delta}$, taken together, may form a ring that is unsubstituted, substituted, or fused to other rings. Typical amino donors that can be used include chiral and achiral amino acids, and chiral and achiral amines. Amino donors that can be used include, by way of example and not limitation, isopropylamine (also referred to as 2-aminopropane), α-phenethylamine (also termed 1-phenylethanamine), and its enantiomers (S)-1-phenylethanamine and (R)-1-phenylethanamine, 2-amino-4-phenylbutane, glycine, L-glutamic acid, L-glutamate, monosodium glutamate, L-alanine, D-alanine, D,L-alanine, L-aspartic acid, L-lysine, D,L-ornithine, β-alanine, taurine, n-octylamine, cyclohexylamine, 1,4-butanediamine (also referred to as putrescine), 1,6-hexanediamine, 6-aminohexanoic acid, 4-aminobutyric acid, tyramine, and benzyl amine, 2-aminobutane, 2-amino-1-butanol, 1-amino-1-phenylethane, 1-amino-1-(2-methoxy-5-fluorophenyl)ethane, 1-amino-1-phenylpropane, 1-amino-1-(4-hydroxyphenyl)propane, 1-amino-1-(4-bromophenyl)propane, 1-amino-1-(4-nitrophenyl)propane, 1-phenyl-2-aminopropane, 1-(3-trifluoromethylphenyl)-2-aminopropane, 2-aminopropanol, 1-amino-1-phenylbutane, 1-phenyl-2-aminobutane, 1-(2,5-dimethoxy-4-methylphenyl)-2-aminobutane, 1-phenyl-3-aminobutane, 1-(4-hydroxyphenyl)-3-aminobutane, 1-amino-2-methylcyclopentane, 1-amino-3-methylcyclopentane, 1-amino-2-methylcyclohexane, 1-amino-1-(2-naphthyl)ethane, 3-methylcyclopentylamine, 2-methylcyclopentylamine, 2-ethylcyclopentylamine, 2-methylcyclohexylamine, 3-methylcyclohexylamine, 1-aminotetralin, 2-aminotetralin, 2-amino-5-methoxytetralin, and 1-aminoindan, including both (R) and (S) single isomers where possible and including all possible salts of the amines.

"Chiral amine" refers to amines of general formula $R^{\alpha}$—$CH(NH_2)$—$R^{\beta}$ and is employed herein in its broadest sense, including a wide variety of aliphatic and alicyclic compounds of different, and mixed, functional types, characterized by the presence of a primary amino group bound to a secondary carbon atom which, in addition to a hydrogen atom, carries either (i) a divalent group forming a chiral cyclic structure, or (ii) two substituents (other than hydrogen) differing from each other in structure or chirality. Divalent groups forming a chiral cyclic structure include, for example, 2-methylbutane-1,4-diyl, pentane-1,4-diyl, hexane-1,4-diyl, hexane-1,5-diyl, 2-methylpentane-1,5-diyl. The two different substituents on the secondary carbon atom ($R^{\alpha}$ and $R^{\beta}$ above) also can vary widely and include alkyl, aralkyl, aryl, halo, hydroxy, lower alkyl, lower alkoxy, lower alkylthio, cycloalkyl, carboxy, carbalkoxy, carbamoyl, mono- and di-(lower alkyl) substituted carbamoyl, trifluoromethyl, phenyl, nitro, amino, mono- and di-(lower alkyl) substituted amino, alkylsulfonyl, arylsulfonyl, alkylcarboxamido, arylcarboxamido, etc., as well as alkyl, aralkyl, or aryl substituted by the foregoing.

"Pyridoxal-phosphate," "PLP," "pyridoxal-5'-phosphate," "PYP," and "P5P" are used interchangeably herein to refer to the compound that acts as a coenzyme in transaminase reactions. In some embodiments, pyridoxal phosphate is defined by the structure 1-(4'-formyl-3'-hydroxy-2'-methyl-5'-pyridyl)methoxyphosphonic acid, CAS number [54-47-7]. Pyridoxal-5'-phosphate can be produced in vivo by phosphorylation and oxidation of pyridoxol (also known as Vitamin $B_6$). In transamination reactions using transaminase enzymes, the amine group of the amino donor is transferred to the coenzyme to produce a keto byproduct, while pyridoxal-5'-phosphate is converted to pyridoxamine phosphate. Pyridoxal-5'-phosphate is regenerated by reaction with a different keto compound (the amino acceptor). The transfer of the amine group from pyridoxamine phosphate to the amino acceptor produces an amine and regenerates the coenzyme. In some embodiments, the pyridoxal-5'-phosphate can be replaced by other members of the vitamin $B_6$ family, including pyridoxine (PN), pyridoxal (PL), pyridoxamine (PM), and their phosphorylated counterparts; pyridoxine phosphate (PNP), and pyridoxamine phosphate (PMP).

"Coding sequence" refers to that portion of a nucleic acid (e.g., a gene) that encodes an amino acid sequence of a protein.

"Naturally-occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

"Recombinant" or "engineered" or "non-naturally occurring" when used with reference to, e.g., a cell, nucleic acid, or polypeptide, refers to a material, or a material corresponding to the natural or native form of the material, that has been modified in a manner that would not otherwise exist in nature, or is identical thereto but produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

"Percentage of sequence identity" and "percentage homology" are used interchangeably herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman, 1981, Adv. Appl. Math. 2:482, by the homology alignment algorithm of Needleman and Wunsch, 1970, J. Mol. Biol. 48:443, by the search for similarity method of Pearson and Lipman, 1988, Proc. Natl. Acad. Sci. USA 85:2444, by computerized implementations of these algorithms (GAP, BESTFIT, FASTA, and TFASTA in the GCG Wisconsin Software Package), or by visual inspection (see generally, Current Protocols in Molecular Biology, F. M. Ausubel et al., eds., Current Protocols, a joint venture between Greene Publishing Associates, Inc. and John Wiley & Sons, Inc., (1995 Supplement) (Ausubel)). Examples of algorithms that are suitable for determining percent sequence identity and sequence similarity are the BLAST and BLAST 2.0 algorithms, which are described in Altschul et al., 1990, J. Mol. Biol. 215: 403-410 and Altschul et al., 1977, Nucleic Acids Res. 3389-3402, respectively. Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff, 1989, Proc Natl Acad Sci USA 89:10915). Exemplary determination of sequence alignment and % sequence identity can employ the BESTFIT or GAP programs in the GCG Wisconsin Software package (Accelrys, Madison WI), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, a "reference sequence based on SEQ ID NO:2 having at the residue corresponding to X34 an alanine" or X34A refers to a reference sequence in which the corresponding residue at X34 in SEQ ID NO:2, which is a threonine, has been changed to alanine.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence for optimal alignment of the two sequences. The comparison window can be longer than 20 contiguous residues, and includes, optionally 30, 40, 50, 100, or longer windows.

"Substantial identity" refers to a polynucleotide or polypeptide sequence that has at least 80 percent sequence identity, at least 85 percent identity and 89 to 95 percent sequence identity, more usually at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). Preferably, residue positions which are not identical differ by conservative amino acid substitutions.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered transaminase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" or "residue difference" refers to a change in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X34 as compared to SEQ ID NO: 2" refers to a change of the amino acid residue at the polypeptide position corresponding to position 34 of SEQ ID NO:2. Thus, if the reference polypeptide of SEQ ID NO: 2 has a threonine at position 34, then a "residue difference at position X34 as compared to SEQ ID NO:2" an amino acid substitution of any residue other than threonine at the position of the polypeptide corresponding to position 34 of SEQ ID NO: 2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some embodiments, where more than one amino acid can appear in a specified residue position, the alternative amino acids can be listed in the form XnY/Z, where Y and Z represent alternate amino acid residues. In some instances (e.g., in Tables 5.1 and 6.1), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. Furthermore, in some instances, a polypeptide of the present disclosure can include one or more amino acid residue differences relative to a reference sequence, which is indicated by a list of the specified positions where changes are made relative to the reference sequence.

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid, e.g., alanine, valine, leucine, and isoleucine; an amino acid with hydroxyl side chain is substituted with another amino acid with a hydroxyl side chain, e.g., serine and threonine; an amino acid having aromatic side chains is substituted with another amino acid having an aromatic side chain, e.g., phenylalanine, tyrosine, tryptophan, and histidine; an amino acid with a basic side chain is substituted with another amino acid with a basic side chain, e.g., lysine and arginine; an amino acid with an acidic side chain is substituted with another amino acid with an acidic side chain, e.g., aspartic acid or glutamic acid; and a hydrophobic or hydrophilic amino acid is replaced with another hydrophobic or hydrophilic amino acid, respectively. Exemplary conservative substitutions are provided in Table 1 below.

TABLE 1

| Residue | Possible Conservative Substitutions |
|---|---|
| A, L, V, I | Other aliphatic (A, L, V, I)<br>Other non-polar (A, L, V, I, G, M) |
| G, M | Other non-polar (A, L, V, I, G, M) |
| D, E | Other acidic (D, E) |
| K, R | Other basic (K, R) |
| N, Q, S, T | Other polar |
| H, Y, W, F | Other aromatic (H, Y, W, F) |
| C, P | None |

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine), (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered transaminase enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. In some embodiments, the improved engineered transaminase enzymes comprise insertions of one or more amino acids to the naturally occurring transaminase polypeptide as well as insertions of one or more amino acids to other improved transaminase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the reference polypeptide.

"Fragment" as used herein refers to a polypeptide that has an amino-terminal and/or carboxy-terminal deletion, but where the remaining amino acid sequence is identical to the corresponding positions in the sequence. Fragments can be at least 14 amino acids long, at least 20 amino acids long, at least 50 amino acids long or longer, and up to 70%, 80%, 90%, 95%, 98%, and 99% of the full-length transaminase polypeptide, for example the reference engineered transaminase polypeptide of SEQ ID NO: 2.

"Isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The improved transaminase enzymes may be present within a cell, present in the cellular medium, or prepared in various forms, such as lysates or isolated preparations. As such, in some embodiments, the improved transaminase enzyme can be an isolated polypeptide.

"Substantially pure polypeptide" refers to a composition in which the polypeptide species is the predominant species present (i.e., on a molar or weight basis, it is more abundant than any other individual macromolecular species in the composition), and is generally a substantially purified composition when the object species comprises at least about 50 percent of the macromolecular species present by mole or % weight. Generally, a substantially pure transaminase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated improved transaminase polypeptide is a substantially pure polypeptide composition.

"Stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess (e.e.) calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Enantiomeric excess and diastereomeric excess are types of stereomeric excess.

"Highly stereoselective" refers to a chemical or enzymatic reaction that is capable of converting a substrate, e.g., compound (2), to its corresponding chiral amine product, e.g., compound (3), with at least about 85% stereomeric excess.

"Improved enzyme property" refers to a transaminase polypeptide that exhibits an improvement in any enzyme property as compared to a reference transaminase. For the engineered transaminase polypeptides described herein, the comparison is generally made to the wild-type transaminase enzyme, although in some embodiments, the reference transaminase can be another engineered transaminase. Enzyme properties for which improvement is desirable include, but are not limited to, enzymatic activity (which can be expressed in terms of percent conversion of the substrate), thermo stability, solvent stability, pH activity profile, cofactor requirements, refractoriness to inhibitors (e.g., substrate or product inhibition), product or substrate tolerance, and stereoselectivity (including enantioselectivity).

"Increased enzymatic activity" refers to an improved property of the engineered transaminase polypeptides, which can be represented by an increased specific activity (e.g., product produced/time/weight protein) or an increased percent conversion of the substrate to the product (e.g., percent conversion of starting amount of substrate to product in a specified time period using a specified amount of transaminase) as compared to the reference transaminase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.2 fold the enzymatic activity of the corresponding wild-type transaminase enzyme, to as much as 2 fold, 5 fold, 10 fold, 20 fold, 25 fold, 50 fold, 75 fold, 100 fold, or more enzymatic activity than the naturally occurring transaminase or another engineered transaminase from which the transaminase polypeptides were derived. Transaminase activity can be measured by any one of standard assays, such as by monitoring changes in spectrophotometric properties of reactants or products. In some embodiments, the amount of products produced can be measured by High-Performance Liquid Chromatography (HPLC) separation combined with UV absorbance or fluorescent detection following derivatization, such as with o-phthaldialdehyde (OPA). Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

"Conversion" refers to the enzymatic conversion of the substrate(s) to the corresponding product(s). "Percent conversion" refers to the percent of the substrate that is converted to the product within a period of time under specified conditions. Thus, the "enzymatic activity" or "activity" of a transaminase polypeptide can be expressed as "percent conversion" of the substrate to the product.

"Thermostable" refers to a transaminase polypeptide that maintains similar activity (more than 60% to 80% for example) after exposure to elevated temperatures (e.g., 40-80° C.) for a period of time (e.g., 0.5-24 hrs) compared to the wild-type enzyme.

"Solvent stable" refers to a transaminase polypeptide that maintains similar activity (more than e.g., 60% to 80%) after exposure to varying concentrations (e.g., 5-99%) of solvent (ethanol, isopropyl alcohol, dimethylsulfoxide (DMSO), tetrahydrofuran, 2-methyltetrahydrofuran, acetone, toluene, butyl acetate, methyl tert-butyl ether, etc.) for a period of time (e.g., 0.5-24 hrs) compared to the wild-type enzyme.

"Thermo- and solvent stable" refers to a transaminase polypeptide that is both thermostable and solvent stable.

"Stringent hybridization" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (see, e.g., Baldino et al., Methods Enzymology 168:761-777; Bolton et al., 1962, Proc. Natl. Acad. Sci. USA 48:1390; Bresslauer et al., 1986, Proc. Natl. Acad Sci USA 83:8893-8897; Freier et al., 1986, Proc. Natl. Acad. Sci USA 83:9373-9377; Kierzek et al., Biochemistry 25:7840-7846; Rychlik et al., 1990, Nucleic Acids Res 18:6409-6412 (erratum, 1991, Nucleic Acids Res 19:698); Sambrook et al., supra); Suggs et al., 1981, In Developmental Biology Using Purified Genes (Brown et al., eds.), pp. 683-693, Academic Press; and Wetmur, 1991, Crit Rev Biochem Mol Biol 26:227-259. All publications incorporated herein by reference). In some embodiments, the polynucleotide encodes the polypeptide disclosed herein and hybridizes under defined conditions, such as moderately stringent or highly stringent conditions, to the complement of a sequence encoding an engineered transaminase enzyme of the present disclosure.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Heterologous" polynucleotide refers to any polynucleotide that is introduced into a host cell by laboratory techniques and includes polynucleotides that are removed from a host cell, subjected to laboratory manipulation, and then reintroduced into a host cell.

"Codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the transaminase enzymes may be codon optimized for optimal production from the host organism selected for expression.

"Preferred, optimal, high codon usage bias codons" refers interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (see GCG CodonPreference, Genetics Computer Group Wisconsin Package; CodonW, John Peden, University of Nottingham; McInerney, J. O, 1998, Bioinformatics 14:372-73; Stenico et al., 1994, Nucleic Acids Res. 222437-46; Wright, F., 1990, Gene 87:23-29). Codon usage tables are available for a growing list of organisms (see for example, Wada et al., 1992, Nucleic Acids Res. 20:2111-2118; Nakamura et al., 2000, Nucl. Acids Res. 28:292; Duret, et al., supra; Henaut and Danchin, "*Escherichia coli* and *Salmonella,*" 1996, Neidhardt, et al. Eds., ASM Press, Washington D.C., p. 2047-2066. The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (see for example, Mount, D., Bioinformatics: Sequence and Genome Analysis, Chapter 8, Cold Spring Harbor Laboratory Press, Cold Spring Harbor, N.Y., 2001; Uberbacher, E. C., 1996, Methods Enzymol. 266:259-281; Tiwari et al., 1997, Comput. Appl. Biosci. 13:263-270).

"Control sequence" is defined herein to include all components, which are necessary or advantageous for the expression of a polynucleotide and/or polypeptide of the present disclosure. Each control sequence may be native or foreign to the nucleic acid sequence encoding the polypeptide. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Suitable reaction conditions" refer to those conditions in the biocatalytic reaction solution (e.g., ranges of enzyme loading, substrate loading, cofactor loading, temperature, pH, buffers, co-solvents, etc.) under which a transaminase polypeptide of the present disclosure is capable of converting a substrate compound to a product compound (e.g., conversion of compound (2) to compound (3)). Exemplary "suitable reaction conditions" are provided in the detailed description and illustrated by the Examples.

"Loading", such as in "compound loading" or "enzyme loading" or "cofactor loading" refers to the concentration or amount of a component in a reaction mixture at the start of the reaction.

"Substrate" in the context of a biocatalyst mediated process refers to the compound or molecule acted on by the biocatalyst. For example, an exemplary substrate for the engineered transaminase biocatalysts in the process disclosed herein is compound (2).

"Product" in the context of a biocatalyst mediated process refers to the compound or molecule resulting from the action of the biocatalyst. For example, an exemplary product for the engineered transaminase biocatalysts in the process disclosed herein is compound (3).

"Heteroalkyl, "heteroalkenyl," and "heteroalkynyl," refer to alkyl, alkenyl and alkynyl as defined herein in which one or more of the carbon atoms are each independently replaced with the same or different heteroatoms or heteroatomic groups. Heteroatoms and/or heteroatomic groups which can replace the carbon atoms include, but are not limited to, —O—, —S—, —S—O—, —$NR^{\gamma}$—, —PH—, —S(O)—, —S(O)2-, —S(O)$NR^{\gamma}$—, —$S(O)_2NR^{\gamma}$—, and the like, including combinations thereof, where each Rr is independently selected from hydrogen, alkyl, heteroalkyl, cycloalkyl, heterocycloalkyl, aryl, heteroaryl, and other suitable substituents.

"Aryl" refers to an unsaturated aromatic carbocyclic group of from 6 to 12 carbon atoms inclusively having a single ring (e.g., phenyl) or multiple condensed rings (e.g., naphthyl or anthryl). Exemplary aryls include phenyl, pyridyl, naphthyl and the like.

"Arylalkyl" refers to an alkyl substituted with an aryl, i.e., aryl-alkyl- groups, preferably having from 1 to 6 carbon atoms inclusively in the alkyl moiety and from 6 to 12 carbon atoms inclusively in the aryl moiety. Such arylalkyl groups are exemplified by benzyl, phenethyl and the like.

"Arylalkenyl" refers to an alkenyl substituted with an aryl, i.e., aryl-alkenyl- groups, preferably having from 2 to 6 carbon atoms inclusively in the alkenyl moiety and from 6 to 12 carbon atoms inclusively in the aryl moiety.

"Arylalkynyl" refers to an alkynyl substituted with an aryl, i.e., aryl-alkynyl- groups, preferably having from 2 to 6 carbon atoms inclusively in the alkynyl moiety and from 6 to 12 carbon atoms inclusively in the aryl moiety.

"Cycloalkyl" refers to cyclic alkyl groups of from 3 to 12 carbon atoms inclusively having a single cyclic ring or multiple condensed rings which can be optionally substituted with from 1 to 3 alkyl groups. Exemplary cycloalkyl groups include, but are not limited to, single ring structures such as cyclopropyl, cyclobutyl, cyclopentyl, cyclooctyl, 1-methylcyclopropyl, 2-methylcyclopentyl, 2-methylcyclooctyl, and the like, or multiple ring structures, including bridged ring systems, such as adamantyl, and the like.

"Cycloalkylalkyl" refers to an alkyl substituted with a cycloalkyl, i.e., cycloalkyl-alkyl- groups, preferably having from 1 to 6 carbon atoms inclusively in the alkyl moiety and from 3 to 12 carbon atoms inclusively in the cycloalkyl moiety. Such cycloalkylalkyl groups are exemplified by cyclopropylmethyl, cyclohexylethyl and the like.

"Cycloalkylalkenyl" refers to an alkenyl substituted with a cycloalkyl, i.e., cycloalkyl -alkenyl- groups, preferably having from 2 to 6 carbon atoms inclusively in the alkenyl moiety and from 3 to 12 carbon atoms inclusively in the cycloalkyl moiety.

"Cycloalkylalkynyl" refers to an alkynyl substituted with a cycloalkyl, i.e., cycloalkyl-alkynyl- groups, preferably having from 2 to 6 carbon atoms inclusively in the alkynyl moiety and from 3 to 12 carbon atoms inclusively in the cycloalkyl moiety.

"Amino" refers to the group —$NH_2$. Substituted amino refers to the group —$NHR^{\eta}$, $NR^{\eta}R^{\eta}$, and $NR^{\eta}R^{\eta}R^{\eta}$, where each $R^{\eta}$ is independently selected from substituted or unsubstituted alkyl, cycloalkyl, cycloheteroalkyl, alkoxy, aryl, heteroaryl, heteroarylalkyl, acyl, alkoxycarbonyl, sulfanyl, sulfinyl, sulfonyl, and the like. Typical amino groups include, but are limited to, dimethylamino, diethylamino, trimethylammonium, triethylammonium, methylysulfonylamino, furanyl-oxy-sulfamino, and the like.

"Alkylamino" refers to a —$NHR^{\xi}$ group, where $R^{\xi}$ is an alkyl, an N-oxide derivative, or a protected derivative thereof, e.g., methylamino, ethylamino, n-propylamino, isopropylamino, n-butylamino, iso-butylamino, tert-butylamino, or methylamino-N-oxide, and the like.

"Arylamino" refers to —$NHR^{\xi}$ where $R^{\xi}$ is an aryl group, which can be optionally substituted.

"Heteroarylamino" refers to —$NHR^{\lambda}$ where $R^{\lambda}$ is a heteroaryl group, which can be optionally substituted.

"Aminoalkyl" refers to an alkyl group in which one or more of the hydrogen atoms is replaced with an amino group, including a substituted amino group.

"Oxo" refers to =O

"Oxy" refers to a divalent group —O—, which may have various substituents to form different oxy groups, including ethers and esters.

"Alkoxy" or "alkyloxy" are used interchangeably herein to refer to the group —OR, wherein R is an alkyl group, including optionally substituted alkyl groups as also defined herein.

"Aryloxy" refers to —$OR^{\lambda}$ groups, where $R^{\lambda}$ is an aryl group, which can be optionally substituted.

"Heteroaryloxy" refers to —$OR^{\sigma}$, where $R^{\sigma}$ is a heteroaryl group, which can be optionally substituted.

"Carboxy" refers to —COOH.

"Carboxyalkyl" refers to an alkyl substituted with a carboxy group.

"Carbonyl" refers to —C(O)—, which may have a variety of substituents to form different carbonyl groups including acids, acid halides, aldehydes, amides, esters, and ketones.

"Alkylcarbonyl" refers to —C(O)$R^{\xi}$, where $R^{\xi}$ is an alkyl group, which can be optionally substituted.

"Arylcarbonyl" refers to —C(O)$R^{\lambda}$, where $R^{\lambda}$ is an aryl group, which can be optionally substituted.

"Heteroarylcarbonyl" refers to —C(O)$R^{\sigma}$ where $R^{\sigma}$ is a heteroaryl group, which can be optionally substituted.

"Alkyloxycarbonyl" refers to —C(O)$OR^{\xi}$, where $R^{\xi}$ is an alkyl group, which can be optionally substituted.

"Aryloxycarbonyl" refers to —C(O)$OR^{\lambda}$, where $R^{\lambda}$ is an aryl group, which can be optionally substituted.

"Heteroaryloxycarbonyl" refers to —C(O)OR$^{\sigma}$, where R$^{\sigma}$ is a heteroaryl group, which can be optionally substituted.

"Arylalkyloxycarbonyl" refers to —C(O)OR$^{\rho}$, where R$^{\rho}$ is an aryl-alkyl- group, which can be optionally substituted.

"Alkylcarbonyloxy" refers to —OC(O)—R$^{\xi}$, where R is an alkyl group, which can be optionally substituted.

"Arylcarbonyloxy" refers to —OC(O)R$^{\lambda}$, where R is an aryl group, which can be optionally substituted.

"Heteroarylalkyloxycarbonyl" refers to —C(O)OR$^{\omega}$, where R$^{\omega}$ is a heteroarylalkyl group, which can be optionally substituted.

"Heteroarylcarbonyloxy" refers to —OC(O)R$^{\sigma}$, where R$^{\sigma}$ is an heteroaryl group, which can be optionally substituted.

"Aminocarbonyl" refers to —C(O)$NH_2$. Substituted aminocarbonyl refers to —C(O)NR$^{\eta}$R$^{\eta}$, where the amino group NR$^{\eta}$R$^{\eta}$ is as defined herein.

"Aminocarbonylalkyl" refers to an alkyl substituted with an aminocarbonyl group.

"Halogen" or "halo" refers to fluoro, chloro, bromo and iodo.

"Haloalkyl" refers to an alkyl group substituted with one or more halogen. Thus, the term "haloalkyl" is meant to include monohaloalkyls, dihaloalkyls, trihaloalkyls, etc. up to perhaloalkyls. For example, the expression "(C1 C2) haloalkyl" includes 1-fluoromethyl, difluoromethyl, trifluoromethyl, 1-fluoroethyl, 1,1-difluoroethyl, 1,2-difluoroethyl, 1,1,1 trifluoroethyl, perfluoroethyl, etc.

"Hydroxy" refers to —OH.

"Hydroxyalkyl" refers to an alkyl substituted with one or more hydroxy group.

"Cyano" refers to —CN.

"Nitro" refers to —NO2.

"Thio" or "sulfanyl" refers to —SH. Substituted thio or sulfanyl refers to —S—R$^{q}$, where R$^{q}$ is an alkyl, aryl or other suitable substituent.

"Alkylthio" refers to —SR$^{\xi}$, where R$^{\xi}$ is an alkyl, which can be optionally substituted. Typical alkylthio group include, but are not limited to, methylthio, ethylthio, n-propylthio, and the like.

"Arylthio" refers to —SR$^{\lambda}$, where R$^{\lambda}$ is an aryl, which can be optionally substituted. Typical arylthio groups include, but are not limited to, phenylthio, (4-methylphenyl) thio, pyridinylthio, and the like.

"Heteroarylthio" refers to —SR$^{\sigma}$, where R$^{\sigma}$ is a heteroaryl, which can be optionally substituted.

"Sulfonyl" refers to —$SO_2$—. Substituted sulfonyl refers to —$SO_2$—R$^{\eta}$, where R$^{\eta}$ is an alkyl, aryl or other suitable substituent.

"Alkylsulfonyl" refers to —$SO_2$—R$^{\xi}$, where R$^{\xi}$ is an alkyl, which can be optionally substituted. Typical alkylsulfonyl groups include, but are not limited to, methylsulfonyl, ethylsulfonyl, n-propylsulfonyl, and the like.

"Arysulfonyl" refers to —$SO_2$—R$^{\lambda}$, where R$^{\lambda}$ is an aryl, which can be optionally substituted. Typical arylsulfonyl groups include, but are not limited to, phenylsulfonyl, (4-methylphenyl)sulfonyl, pyridinylsulfonyl, and the like.

"Heteroarylsulfonyl" refers to —$SO_2$—R$^{\sigma}$, where R$^{\sigma}$ is a heteroaryl group, which can be optionally substituted.

"Sulfinyl" refers to —SO—. Substituted sulfinyl refers to —SO—R$^{\eta}$, where R$^{\eta}$ is an alkyl, aryl or other suitable substituent.

"Alkylsulfinyl" refers to —SO—R$^{\xi}$, where R$^{\xi}$ is an alkyl, which can be optionally substituted. Typical alkylsulfinyl groups include, but are not limited to, methylsulfinyl, ethylsulfinyl, n-propylsulfinyl, and the like.

"Arysulfinyl" refers to —SO—R$^{\lambda}$, where R$^{\lambda}$ is an aryl, which can be optionally substituted. Typical arylsulfinyl groups include, but are not limited to, phenylsulfinyl, (4-methylphenyl)sulfinyl, pyridinylsulfinyl, and the like.

"Heteroarylsulfinyl" refers to —SO—R$^{\sigma}$, where R$^{\sigma}$ is a heteroaryl group, which can be optionally substituted.

"Alkylaminosulfonylalkyl" refers to an alkyl substituted with an alkyl-NH—SO2- group.

"Arylsulfonylalkyl" refers to an alkyl substituted with an aryl-SO2- group.

"Heteroarylsulfonylalkyl" refers to an alkyl substituted with a heteroaryl-SO2- group.

"Aminosulfonyl" refers to —$SO_2NH_2$. Substituted aminosulfonyl refers to —$SO_2$NR$^{\delta}$R$^{\delta}$, where the amino group —NR$^{\eta}$R$^{\eta}$ is as defined herein.

"Heteroaryl" refers to an aromatic heterocyclic group of from 1 to 10 carbon atoms inclusively and 1 to 4 heteroatoms inclusively selected from oxygen, nitrogen and sulfur within the ring. Such heteroaryl groups can have a single ring (e.g., pyridyl or furyl) or multiple condensed rings (e.g., indolizinyl or benzothienyl).

"Heteroarylalkyl" refers to an alkyl substituted with a heteroaryl, i.e., heteroaryl-alkyl- groups, preferably having from 1 to 6 carbon atoms inclusively in the alkyl moiety and from 5 to 12 ring atoms inclusively in the heteroaryl moiety. Such heteroarylalkyl groups are exemplified by pyridylmethyl and the like.

"Heteroarylalkenyl" refers to an alkenyl substituted with a heteroaryl, i.e., heteroaryl-alkenyl- groups, preferably having from 2 to 6 carbon atoms inclusively in the alkenyl moiety and from 5 to 12 ring atoms inclusively in the heteroaryl moiety.

"Heteroarylalkynyl" refers to an alkynyl substituted with a heteroaryl, i.e., heteroaryl-alkynyl- groups, preferably having from 2 to 6 carbon atoms inclusively in the alkynyl moiety and from 5 to 12 ring atoms inclusively in the heteroaryl moiety.

"Heterocycle", "heterocyclic" and interchangeably "heterocycloalkyl" refer to a saturated or unsaturated group having a single ring or multiple condensed rings, from 2 to 10 carbon ring atoms inclusively and from 1 to 4 hetero ring atoms inclusively selected from nitrogen, sulfur or oxygen within the ring. Such heterocyclic groups can have a single ring (e.g., piperidinyl or tetrahydrofuryl) or multiple condensed rings (e.g., indolinyl, dihydrobenzofuran or quinuclidinyl). Examples of heterocycles include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, imidazoline, piperidine, piperazine, pyrrolidine, indoline and the like.

"Heterocycloalkylalkyl" refers to an alkyl substituted with a heterocycloalkyl, i.e., heterocycloalkyl-alkyl- groups, preferably having from 1 to 6 carbon atoms inclusively in the alkyl moiety and from 3 to 12 ring atoms inclusively in the heterocycloalkyl moiety.

"Heterocycloalkylalkenyl" refers to an alkenyl substituted with a heterocycloalkyl, i.e., heterocycloalkyl-alkenyl- groups, preferably having from 2 to 6 carbon atoms inclusively in the alkenyl moiety and from 3 to 12 ring atoms inclusively in the heterocycloalkyl moiety.

"Heterocycloalkylalkynyl" refers to an alkynyl substituted with a heterocycloalkyl, i.e., heterocycloalkyl-alkynyl- groups, preferably having from 2 to 6 carbon atoms inclusively in the alkynyl moiety and from 3 to 12 ring atoms inclusively in the heterocycloalkyl moiety.

"Leaving group" generally refers to any atom or moiety that is capable of being displaced by another atom or moiety in a chemical reaction. More specifically, a leaving group refers to an atom or moiety that is readily displaced and substituted by a nucleophile (e.g., an amine, a thiol, an alcohol, or cyanide). Such leaving groups are well known and include carboxylates, N-hydroxysuccinimide ("NHS"), N-hydroxybenzotriazole, a halogen (fluorine, chlorine, bromine, or iodine), and alkyloxy groups. Non-limiting characteristics and examples of leaving groups can be found, for example in Organic Chemistry, 2d ed., Francis Carey (1992), pages 328-331; Introduction to Organic Chemistry, 2d ed., Andrew Streitwieser and Clayton Heathcock (1981), pages 169-171; and Organic Chemistry, 5th Ed., John McMurry, Brooks/Cole Publishing (2000), pages 398 and 408; all of which are incorporated herein by reference.

Unless otherwise specified, positions occupied by hydrogen in the foregoing groups can be further substituted with substituents exemplified by, but not limited to, hydroxy, oxo, nitro, methoxy, ethoxy, alkoxy, substituted alkoxy, trifluoromethoxy, haloalkoxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkoxyalkyl, thio, alkylthio, acyl, carboxy, alkoxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; and preferred heteroatoms are oxygen, nitrogen, and sulfur. It is understood that where open valences exist on these substituents they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further understood that the above substitutions can be made provided that replacing the hydrogen with the substituent does not introduce unacceptable instability to the molecules of the present disclosure, and is otherwise chemically reasonable.

"Optional" or "optionally" means that the subsequently described event or circumstance may or may not occur, and that the description includes instances where the event or circumstance occurs and instances in which it does not. One of ordinary skill in the art would understand that with respect to any molecule described as containing one or more optional substituents, only sterically practical and/or synthetically feasible compounds are meant to be included. "Optionally substituted" refers to all subsequent modifiers in a term or series of chemical groups. For example, in the term "optionally substituted arylalkyl, the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

"Protecting group" refers to a group of atoms that mask, reduce or prevent the reactivity of the functional group when attached to a reactive functional group in a molecule. Typically, a protecting group may be selectively removed as desired during the course of a synthesis. Examples of protecting groups can be found in Wuts and Greene, "Greene's Protective Groups in Organic Synthesis," 4th Ed., Wiley Interscience (2006), and Harrison et al., Compendium of Synthetic Organic Methods, Vols. 1-8, 1971-1996, John Wiley & Sons, NY. Functional groups that can have a protecting group include, but are not limited to, hydroxy, amino, and carboxy groups. Representative amino protecting groups include, but are not limited to, formyl, acetyl, trifluoroacetyl, benzyl, benzyloxycarbonyl ("CBZ"), tert-butoxycarbonyl ("Boc"), trimethylsilyl ("TMS"), 2-trimethylsilyl-ethanesulfonyl ("SES"), trityl and substituted trityl groups, allyloxycarbonyl, 9-fluorenylmethyloxycarbonyl ("FMOC"), nitro-veratryloxycarbonyl ("NVOC") and the like.

"Polyol" as used herein refers to compounds containing multiple hydroxy groups. In reference to polymers, polyol includes polymers with hydroxyl functional groups. Exemplary polymeric polyols include, by way of example and not limitation, polyethers and polyesters, e.g., polyethylene glycol, polypropylene glycol, poly(tetramethylene) glycol and polytetrahydrofuran.

5.3 Engineered Transaminase Polypeptides

The present disclosure provides engineered polypeptides having transaminase activity, polynucleotides encoding the polypeptides, and methods for using the polypeptides. Where the foregoing description relates to polypeptides, it is to be understood that it also describes the polynucleotides encoding the polypeptides.

Transaminases, also known as aminotransferases, catalyze the transfer of an amino group from a primary amine of an amino donor substrate to the carbonyl group (e.g., a keto or aldehyde group) of an amino acceptor molecule. Transaminases have been identified from a variety of microorganisms including but not limited to *Alcaligenes denitrificans, Bordetella bronchiseptica, Bordetella parapertussis, Brucella melitensis, Burkholderia malle, Burkholderia pseudomallei, Chromobacterium violaceum, Oceanicola granulosus* HTCC2516, *Oceanobacter* sp. RED65, *Oceanospirillum* sp. MED92, *Pseudomonas putida, Ralstonia solanacearum, Rhizobium meliloti, Rhizobium* sp. (strain NGR234), *Bacillus thuringensis, Klebsiella pneumoniae* and *Vibrio fluvialis* (see e.g., Shin et al., 2001, Biosci. Biotechnol, Biochem. 65:1782-1788).

Transaminases are useful for the chiral resolution of racemic amines by exploiting the ability of the transaminases to carry out the reaction in a stereospecific manner, i.e., preferential conversion of one enantiomer to the corresponding ketone, thereby resulting in a mixture enriched in the other enantiomer (see, e.g., Koselewski et al., 2009, Org Lett. 11(21):4810-2). The stereoselectivity of transaminases in the conversion of a ketone to the corresponding amine also make these enzymes useful in the asymmetric synthesis of optically pure amines from the corresponding keto compounds (see, e.g., Höhne et al., "Biocatalytic Routes to Optically Active Amines," Chem Cat Chem 1(1):42-51; Zua and Hua, 2009, Biotechnol J. 4(10):1420-31).

The wild-type ω-transaminase from *Vibrio fluvialis* ω-VfT displays high enantioselectivity for (S)-enantiomers of certain chiral amines and has substrate specificity for chiral aromatic amines (see e.g., Shin and Kim, 2002, J. Org. Chem. 67:2848-2853). The high enantioselectivity of ω-VfT has been applied to chiral resolution of amines (see e.g., Yun, et al., 2004, Biotechnol. Bioeng. 87:772-778; Shin and Kim, 1997, Biotechnol. Bioeng. 55:348-358; M. Hçhne, et al., 2008, Adv. Synth. Catal. 350:802-807). The ω-VfT transaminase has also been used in the asymmetric synthesis of optically pure amines using a prochiral ketone substrate. However, the use of this transaminase in asymmetric synthesis of chiral amines is limited by the unfavorable equilibrium of the reverse reaction (see e.g., Shin and Kim, 1999, Biotechnol. Bioeng. 65, 206-211); inhibition of by the chiral amine product (see e.g., Shin et al., 2001, Biotechnol Bioeng 73:179-187; Yun and Kim, 2008, Biosci. Biotechnol. Biochem. 72(11):3030-3033); low activity on amine acceptors having bulky side chains, such as aromatic groups (see e.g., Shin and Kim, 2002, J. Org. Chem. 67:2848-2853); and low enzyme stability (see e.g., Yun and Kim, supra).

Variant transaminases derived from the ω-VfT transaminase of *Vibrio fluvialis* have been reported that have increased resistance to aliphatic ketones (see e.g., Yun et al., 2005, Appl Environ Micriobiol. 71(8):4220-4224) and broadened amino donor substrate specificity (see e.g., Cho et al., 2008, Biotechnol Bioeng. 99(2):275-84). U.S. Pat. Nos. 8,470,564, 9,029,106, 9,512,410, 9,944,909, 10,323,233, and 10,550,370 (each of which is hereby incorporated by reference herein) describe engineered transaminases derived from ω-VfT that have improved properties for use in synthesis of chiral amine compounds including increased stability to temperature and/or organic solvent, and increased enzymatic activity towards structurally different amino acceptor molecules. Patent publication U.S. Pat. Nos. 8,852,900 and 8,932,838 (each of which is hereby incorporated by reference herein) describes engineered transaminases derived from ω-VfT that are optimized for the enantioselective conversion of the substrate 3'-hydroxyacetophenone to the product (S)-3-(1-aminoethyl)-phenol.

Significantly, the present disclosure identifies amino acid residue positions and corresponding amino acid residue substitutions in the engineered transaminase polypeptide that can increase the enzymatic activity, enantioselectivity, stability, substrate tolerance, and refractoriness to product inhibition.

The identification of the specific residue positions and substitutions in the engineered transaminase polypeptides of the present disclosure by engineering through directed evolution methods using structure-based rational sequence library design with screening for improved functional properties using an activity assay based on the conversion of the prochiral ketone group of an exemplary substrate amine acceptor of compound to its corresponding chiral amine product. Specifically, the conversion of the ketone of compound (2) to the corresponding chiral amine compound of compound (3), as shown in Scheme 4.

In some embodiments, the present invention provides details of an ATA enzyme suitable for the production of an intermediate (1S)-1-imidazo[1,2-a]pyridin-6-ylethanamine (3) which in further steps utilized to produce potent small molecule drug Savolinitib (1).

(1)

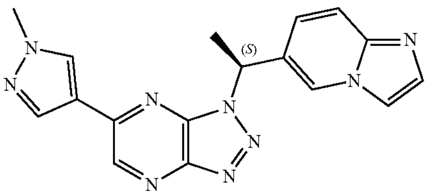

Savolinitib, compound (1) or 3-[(1S)-1-imidazo[1,2-a]pyridin-6-ylethyl]-5-(1-methylpyrazol-4-yl)triazolo[4,5-b]pyrazine.

The current chemical synthetic approach to produce compound (1) involves four steps, as shown in Scheme 3, to replace an earlier process involving seven steps (WO2020/053198). This new approach not only eliminates unwanted chiral resolution of the final compound (1) at the last step that lead to wasting 50% of the product, but it also avoids several isolation and purification steps of the intermediates from the original route. More importantly, it introduces the chiral center in the first step using an engineered ATA enzyme to generate enantioselective amine (3) which is carried through the rest of the synthesis.

Scheme 3

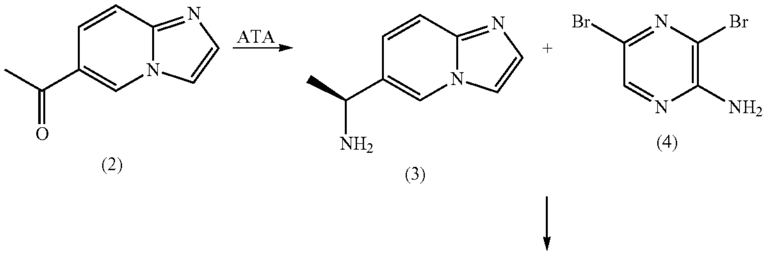

(2) (3) (4)

-continued

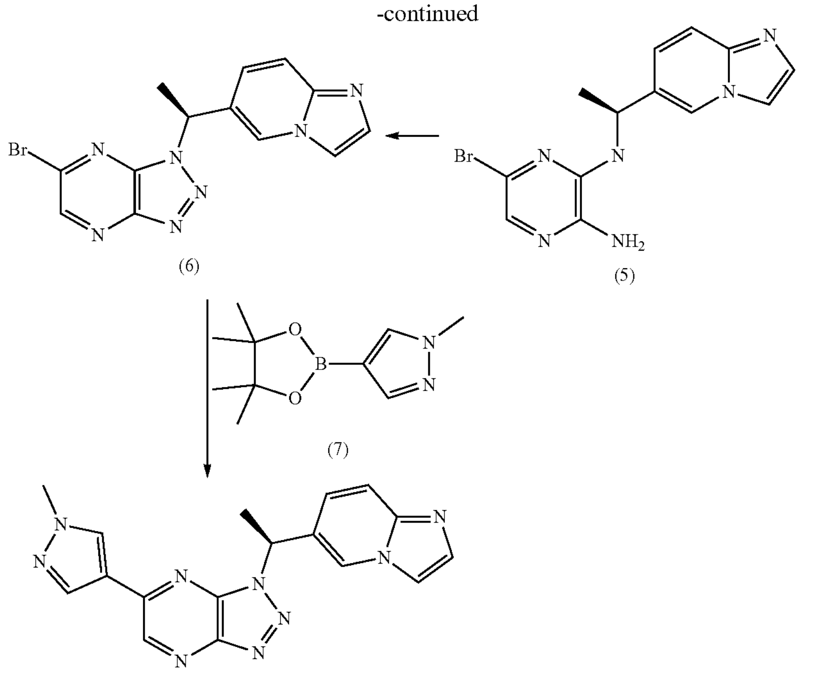

(6) (5) (7) (1)

In some embodiments, the engineered transaminases of the present disclosure were evolved to further improve activity and substrate tolerance in the asymmetric enantioselective transamination of the substrate ketone 1-imidazo [1,2-a]pyridin-6-ylethanone (2) to product (1S)-1-imidazo [1,2-a]pyridin-6-ylethanamine (3) as shown in Scheme 4.

Scheme 4

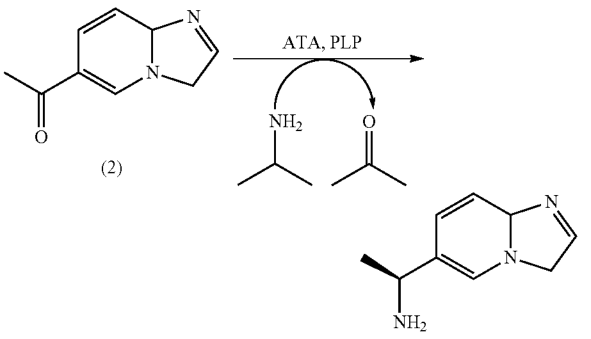

(2) (3)

The engineered transaminase polypeptides adapted for efficient conversion of ketone substrate compounds to chiral amine product compounds have one or more residue differences as compared to the amino acid sequence of the reference engineered transaminase polypeptide of SEQ ID NO: 4. The residue differences are associated with enhancements in enzyme properties, including enzymatic activity, enzyme stability, substrate tolerance, and resistance to inhibition by the product amine.

The present disclosure provides engineered polypeptides having transaminase activity (also referred to herein as "engineered transaminase polypeptides") useful for the selective transamination of amino acceptor substrate compounds to produce chiral amine products, which, in some embodiments, can include compound (3). Accordingly, in one aspect, the present disclosure provides engineered polypeptides having transaminase activity which are capable of converting substrate compound (2) to product compound (3) as shown in Scheme 4.

The engineered polypeptides of the present disclosure are non-naturally occurring transaminases engineered to have improved enzyme properties (such as increased activity) as compared to the wild-type transaminase polypeptide of *Vibrio fluvialis* JS17 (GenBank Acc. No. AEA39183.1, GI: 327207066; SEQ ID NO:2), and also as compared to the reference engineered transaminase polypeptide of SEQ ID NO: 4, which was used as the starting backbone sequence for the directed evolution of the engineered polypeptides of the present disclosure. The reference engineered transaminase polypeptide of SEQ ID NO:4 has 26 amino acid differences relative to the wild-type transaminase of *Vibrio fluvialis* JS17 (SEQ ID NO:2).

The engineered transaminase polypeptides of the present disclosure were generated by directed evolution of SEQ ID NO: 4 for efficient conversion of compound (2) to compound (3) under certain industrially relevant conditions and have one or more residue differences as compared to a reference engineered transaminase polypeptide. These residue differences are associated with improvements in various enzyme properties, particularly increased activity, increased stereoselectivity, increased stability, and tolerance of increased substrate and/or product concentration (e.g., decreased product inhibition). Accordingly, in some embodiments, the engineered polypeptides having transaminase activity are capable of converting the substrate compound (2) to compound (3) with an activity that is increased at least about 1.2 fold, 1.5 fold, 2 fold, 3 fold, 4 fold, 5 fold, 10 fold, 20 fold, 30 fold, 40 fold, 50 fold, 100 fold, or more relative to the activity of a reference polypeptide (e.g., SEQ ID NO: 4 and/or 6), under suitable reaction conditions. In some embodiments, the engineered polypeptides having transaminase activity are capable of converting the substrate of compound (2) to compound (3) with a percent conversion of at least about 40%, at least about 50%, at least about 60%, at least about 70%, at least about 80%, or at least about 90%, at least about 91%, at least about 92%, at least about 93%, at least about 94%, at least about 95%, at least about 96%, at least about 97%, at least about 98%, or at least about 99%, in a reaction time of about 48 h, about 36 h, about 24 h, or even a shorter length of time, under suitable reaction conditions. In some embodiments, the engineered polypeptides having transaminase activity are capable of converting compound (2) to compound (3) in diastereomeric excess of at least 90%, 95%, 97%, 98%, 99%, or greater, under suitable reaction conditions.

The present disclosure provides numerous exemplary engineered transaminase polypeptides comprising amino acid sequences of the even-numbered sequence identifiers SEQ ID NO: 6-358. These exemplary engineered transaminase polypeptides comprise amino acid sequences that include one or more of the following residue differences associated with their improved properties for conversion of compound (2) to compound (3) as compared to a reference sequence (e.g., SEQ ID NO: 4 and/or 6).

In some cases, the exemplary engineered polypeptides have an amino acid sequence that further comprises one or more residue differences as compared to a reference sequence (e.g., SEQ ID NO: 4 and/or 6). In some cases, the exemplary engineered polypeptides have an amino acid sequence that further comprises one or more residue differences as compared to a reference sequence (e.g., SEQ ID NO: 4 and/or 6).

In some embodiments, the engineered polypeptide comprises an amino acid sequence that is at least about 80%, 85%, 86%, 87%, 88%, 89%, 90%, 91%, 92%, 93%, 94%, 95%, 96%, 97%, 98%, 99%, or more, identical to a reference sequence selected from SEQ ID NO: 4 and/or 6, where the polypeptide has transaminase activity and one or more of the improved properties as described herein, for example the ability to convert compound (2) to product compound (3) with increased activity compared to a reference sequence (e.g., the polypeptide of SEQ ID NO: 4 and/or 6). In some embodiments, the reference sequence is SEQ ID NO: 4. In some embodiments, the reference sequence is SEQ ID NO: 6.

In some embodiments, the engineered transaminase polypeptide comprising an amino acid sequence has one or more amino acid residue differences as compared to SEQ ID NO: 4 and/or 6. In some embodiments, the present disclosure provides an engineered polypeptide having transaminase activity comprising an amino acid sequence having at least 80%, 85%, 86%, 87%, 88%, 89%, 90%, 91%, 92%, 93%, 94%, 95%, 96%, 97%, 98%, 99%, or more sequence identity to reference sequence of SEQ ID NO: 4 and/or 6 and at least one amino acid residue difference selected from those substitutions provided herein (See e.g., Tables 5.1 and/or 6.1).

In some embodiments, the present disclosure provides an engineered transaminase polypeptide comprising an amino acid sequence that has one or more amino acid residue differences as compared to SEQ ID NO: 4 selected 13, 41/57/130/415/419, 41/113/415, 53/57, 88, 88/89, 97/415, 148, 227, 260, 302, 355/415/419, 362, 417, and 443, wherein the positions are numbered with reference to SEQ ID NO: 4. In some embodiments, the amino acid differences comprise the substitution(s) 13A, 13E, 13G, 13K, 13S, 41V/57Y/130Y/415F/419D, 41V/113F/415F, 53M/57W, 88K, 88R, 88R/89L, 88V, 97A/415S, 148E, 148G, 227A, 227C, 260T, 302N, 355C/415S/419D, 362G, 417A, 417I, 417V, 443E, and 443M, wherein the positions are numbered with reference to SEQ ID NO: 4. In some additional embodiments, the amino acid differences comprise the substitution(s) T13A, T13E, T13G, T13K, T13S, I41V/F57Y/F130Y/R415F/Q419D, I41V/V113F/R415F, N53M/F57W, L88K, L88R, L88R/M89L, L88V, S97A/R415S, Q148E, Q148G, G227A, G227C, C260T, E302N, R355C/R415S/Q419D, H362G, L417A, L417I, L417V, K443E, and K443M, wherein the positions are numbered with reference to SEQ ID NO: 4.

In some embodiments, the present disclosure provides an engineered transaminase polypeptide comprising an amino acid sequence that has one or more amino acid residue differences as compared to SEQ ID NO: 6 selected from 13, 13/41/57/88/130/415/417, 13/41/57/89/97/417, 13/41/57/97/130/415/417, 13/41/57/97/130/415/417/443, 13/41/57/97/443, 13/41/57/130/417, 13/41/57/417, 13/41/88, 13/41/88/89, 13/41/88/89/97/415/443, 13/41/88/89/417, 13/41/88/97, 13/41/88/130/415/443, 13/41/88/443, 13/41/89/130/148/443, 13/41/89/417, 13/41/89/443, 13/41/97/130/417, 13/41/97/415, 13/41/97/415/417, 13/41/97/417, 13/41/97/417/443, 13/41/130/415/443, 13/41/415, 13/41/415/417, 13/41/415/443, 13/41/417, 13/41/417/443, 13/57/88/89/130/415/443, 13/57/88/97, 13/57/88/97/415/443, 13/57/88/130/415, 13/57/88/130/417/443, 13/57/88/415, 13/57/97/130/415/417/443, 13/57/97/417, 13/88/89/415/417, 13/88/89/415/417/443, 13/88/130/443, 13/88/415, 13/89/97/415/417, 13/89/97/417, 13/89/417, 13/97/148/415, 13/97/415, 13/97/415/417, 13/97/417, 13/130/415, 13/130/415/417, 13/130/417, 13/130/417/443, 13/415, 13/415/417, 13/415/417/443, 13/415/443, 13/417, 13/417/443, 13/443, 23/53/162/233/277/315/415/418/432, 23/53/315/417/418, 23/277/315/395/415/417/432, 23/277/395/417/418, 23/395/418, 23/418, 41, 41/57/88, 41/57/88/415/443, 41/57/130/148/415/417, 41/57/130/443, 41/57/415/417, 41/88/89/97/130/415, 41/88/89/415/417, 41/88/97/130/417, 41/88/130/415/417, 41/88/443, 41/97/130/148/415/417/443, 41/97/417, 41/97/417/443, 41/130/415, 41/130/415/417/443, 41/130/415/443, 41/415/443, 41/417, 41/417/443, 53/162, 53/162/395/417, 53/162/418/432, 53/233, 53/277/395, 53/277/395/417/418, 53/277/415/417, 57/88/97/130/415/443, 57/88/97/130/417, 57/88/97/417, 57/97/130/148/417/443, 57/417, 88, 88/89/130/417, 88/97/415/417/443, 88/130/417/443, 88/148/417/443, 88/415, 88/415/417, 88/415/417/443, 88/417, 89/97/415/417, 89/97/417, 89/443, 97, 97/130, 97/148/415, 97/415, 97/415/417, 97/417, 130, 130/415, 130/417, 130/443, 162/233/415/417, 162/395/415/417, 162/418, 233/315/415/417, 233/315/417, 277/395/415/418/432, 315, 315/415/418/432, 395/418, 415, 415/417, 415/417/418, 415/417/418/432, 415/417/443, 415/443, 417, and 443, wherein the positions are numbered with reference to SEQ ID NO: 6. In some embodiments, the amino acid difference(s) comprise the substitution(s) 13A, 13A/41V/57Y/88R/130Y/415S/417V, 13A/41V/57Y/89L/97A/417V, 13A/41V/57Y/97A/130Y/415S/417I/443M, 13A/41V/57Y/130Y/417V, 13A/41V/57Y/417I, 13A/41V/88R/89L, 13A/41V/88R/443M, 13A/41V/89L/130Y/148G/443M, 13A/41V/89L/443M, 13A/41V/97A/417I, 13A/41V/130Y/415S/443M, 13A/41V/415S, 13A/41V/415S/417I, 13A/41V/415S/417V, 13A/41V/417V/443M, 13A/57Y/88R/89L/130Y/415S/443M, 13A/57Y/88R/97A, 13A/57Y/88R/97A/415S/443M, 13A/57Y/88R/130Y/415S, 13A/57Y/88R/130Y/417V/443M, 13A/57Y/88R/415S, 13A/88R/89L/415S/417V, 13A/88R/130Y/443M, 13A/88R/415S, 13A/89L/417I, 13A/97A/148G/415S, 13A/97A/417I, 13A/97A/417V, 13A/130Y/417V, 13A/415S, 13A/415S/417I/443M, 13A/415S/417V, 13A/

415S/443M, 13A/417I/443M, 13E/41V/57Y/97A/130Y/415S/417V, 13E/41V/57Y/97A/443M, 13E/41V/88R, 13E/41V/88R/89L/97A/415S/443M, 13E/41V/88R/89L/417V, 13E/41V/88R/97A, 13E/41V/88R/130Y/415S/443M, 13E/41V/89L/417V, 13E/41V/97A/130Y/417I, 13E/41V/97A/415S, 13E/41V/97A/415S/417V, 13E/41V/97A/417I/443M, 13E/41V/415S/443M, 13E/41V/417V, 13E/57Y/88R/97A/415S/443M, 13E/57Y/97A/130Y/415S/417V/443M, 13E/57Y/97A/417V, 13E/88R/89L/415S/417I, 13E/88R/89L/415S/417V, 13E/88R/89L/415S/417V/443M, 13E/89L/97A/415S/417V, 13E/89L/97A/417V, 13E/97A/415S, 13E/97A/415S/417V, 13E/130Y/415S, 13E/130Y/415S/417I, 13E/130Y/417I/443M, 13E/130Y/417V, 13E/415S/443M, 13E/417I, 13E/417V, 13E/417V/443M, 13E/443M, 23K/53C/162A/233I/277I/315G/415A/418D/432V, 23K/53C/315G/417V/418D, 23K/277I/315G/395D/415A/417G/432V, 23K/277I/395D/417V/418D, 23K/395D/418D, 23K/418D, 41V, 41V/57Y/88R, 41V/57Y/88R/415S/443M, 41V/57Y/130Y/148G/415S/417I, 41V/57Y/130Y/443M, 41V/57Y/415S/417I, 41V/88R/89L/97A/130Y/415S, 41V/88R/89L/415S/417I, 41V/88R/97A/130Y/417I, 41V/88R/130Y/415S/417I, 41V/88R/443M, 41V/97A/130Y/148G/415S/417V/443M, 41V/97A/417I, 41V/97A/417I/443M, 41V/130Y/415S, 41V/130Y/415S/417I/443M, 41V/130Y/415S/443M, 41V/415S/443M, 41V/417I, 41V/417V, 41V/417V/443M, 53C/162A, 53C/162A/395D/417V, 53C/162A/418D/432V, 53C/233I, 53C/277I/395D, 53C/277I/395D/417V/418D, 53C/277I/415A/417G, 57Y/88R/97A/130Y/415S/443M, 57Y/88R/97A/130Y/417V, 57Y/88R/97A/417I, 57Y/97A/130Y/148G/417I/443M, 57Y/417V, 88R, 88R/89L/130Y/417I, 88R/97A/415S/417I/443M, 88R/130Y/417I/443M, 88R/148G/417V/443M, 88R/415S, 88R/415S/417I, 88R/415S/417I/443M, 88R/415S/417V/443M, 88R/417I, 89L/97A/415S/417I, 89L/97A/417I, 89L/443M, 97A, 97A/130Y, 97A/148G/415S, 97A/415S, 97A/415S/417I, 97A/415S/417V, 97A/417I, 130Y, 130Y/415S, 130Y/417I, 130Y/443M, 162A/233I/415A/417V, 162A/395D/415A/417V, 162A/418D, 233I/315G/415A/417V, 233I/315G/417V, 277I/395D/415A/418D/432V, 315G, 315G/415A/418D/432V, 395D/418D, 415A/417G/418D, 415A/417V, 415A/417V/418D, 415A/417V/418D/432V, 415S, 415S/417I/443M, 415S/417V, 415S/417V/443M, 415S/443M, 417V, and 443M, wherein the positions are numbered with reference to SEQ ID NO: 6. In some additional embodiments, the amino acid difference(s) comprise the substitution(s) T13A, T13A/I41V/F57Y/L88R/F130Y/R415S/L417V, T13A/I41V/F57Y/M89L/S97A/L417V, T13A/I41V/F57Y/S97A/F130Y/R415S/L417I/K443M, T13A/I41V/F57Y/F130Y/L417V, T13A/I41V/F57Y/L417I, T13A/I41V/L88R/M89L, T13A/I41V/L88R/K443M, T13A/I41V/M89L/F130Y/Q148G/K443M, T13A/I41V/M89L/K443M, T13A/I41V/S97A/L417I, T13A/I41V/F130Y/R415S/K443M, T13A/I41V/R415S, T13A/I41V/R415S/L417I, T13A/I41V/R415S/L417V, T13A/I41V/L417V/K443M, T13A/F57Y/L88R/M89L/F130Y/R415S/K443M, T13A/F57Y/L88R/S97A, T13A/F57Y/L88R/S97A/R415S/K443M, T13A/F57Y/L88R/F130Y/R415S, T13A/F57Y/L88R/F130Y/L417V/K443M, T13A/F57Y/L88R/R415S, T13A/L88R/M89L/R415S/L417V, T13A/L88R/F130Y/K443M, T13A/L88R/R415S, T13A/M89L/L417I, T13A/S97A/Q148G/R415S, T13A/S97A/L417I, T13A/S97A/L417V, T13A/F130Y/L417V, T13A/R415S, T13A/R415S/L417I/K443M, T13A/R415S/L417V, T13A/R415S/K443M, T13A/L417I/K443M, T13E/I41V/F57Y/S97A/F130Y/R415S/L417V, T13E/I41V/F57Y/S97A/K443M, T13E/I41V/L88R, T13E/I41V/L88R/M89L/S97A/R415S/K443M, T13E/I41V/L88R/M89L/L417V, T13E/I41V/L88R/S97A, T13E/I41V/L88R/F130Y/R415S/K443M, T13E/I41V/M89L/L417V, T13E/I41V/S97A/F130Y/L417I, T13E/I41V/S97A/R415S, T13E/I41V/S97A/R415S/L417V, T13E/I41V/S97A/L417I/K443M, T13E/I41V/R415S/K443M, T13E/I41V/L417V, T13E/F57Y/L88R/S97A/R415S/K443M, T13E/F57Y/S97A/F130Y/R415S/L417V/K443M, T13E/F57Y/S97A/L417V, T13E/L88R/M89L/R415S/L417I, T13E/L88R/M89L/R415S/L417V, T13E/L88R/M89L/R415S/L417V/K443M, T13E/M89L/S97A/R415S/L417V, T13E/M89L/S97A/L417V, T13E/S97A/R415S, T13E/S97A/R415S/L417V, T13E/F130Y/R415S, T13E/F130Y/R415S/L417I, T13E/F130Y/L417I/K443M, T13E/F130Y/L417V, T13E/R415S/K443M, T13E/L417I, T13E/L417V, T13E/L417V/K443M, T13E/K443M, P23K/N53C/G162A/T233I/T277I/E315G/R415A/G418D/A432V, P23K/N53C/E315G/L417V/G418D, P23K/T277I/E315G/G395D/R415A/L417G/A432V, P23K/T277I/G395D/L417V/G418D, P23K/G395D/G418D, P23K/G418D, I41V, I41V/F57Y/L88R, I41V/F57Y/L88R/R415S/K443M, I41V/F57Y/F130Y/Q148G/R415S/L417I, I41V/F57Y/F130Y/K443M, I41V/F57Y/R415S/L417I, I41V/L88R/M89L/S97A/F130Y/R415S, I41V/L88R/M89L/R415S/L417I, I41V/L88R/S97A/F130Y/L417I, I41V/L88R/F130Y/R415S/L417I, I41V/L88R/K443M, I41V/S97A/F130Y/Q148G/R415S/L417V/K443M, I41V/S97A/L417I, I41V/S97A/L417I/K443M, I41V/F130Y/R415S, I41V/F130Y/R415S/L417I/K443M, I41V/F130Y/R415S/K443M, I41V/R415S/K443M, I41V/L417I, I41V/L417V, I41V/L417V/K443M, N53C/G162A, N53C/G162A/G395D/L417V, N53C/G162A/G418D/A432V, N53C/T233I, N53C/T277I/G395D, N53C/T277I/G395D/L417V/G418D, N53C/T277I/R415A/L417G, F57Y/L88R/S97A/F130Y/R415S/K443M, F57Y/L88R/S97A/F130Y/L417V, F57Y/L88R/S97A/L417I, F57Y/S97A/F130Y/Q148G/L417I/K443M, F57Y/L417V, L88R, L88R/M89L/F130Y/L417I, L88R/S97A/R415S/L417I/K443M, L88R/F130Y/L417I/K443M, L88R/Q148G/L417V/K443M, L88R/R415S, L88R/R415S/L417I, L88R/R415S/L417I/K443M, L88R/R415S/L417V/K443M, L88R/L417I, M89L/S97A/R415S/L417I, M89L/S97A/L417I, M89L/K443M, S97A, S97A/F130Y, S97A/Q148G/R415S, S97A/R415S, S97A/R415S/L417I, S97A/R415S/L417V, S97A/L417I, F130Y, F130Y/R415S, F130Y/L417I, F130Y/K443M, G162A/T233I/R415A/L417V, G162A/G395D/R415A/L417V, G162A/G418D, T233I/E315G/R415A/L417V, T233I/E315G/L417V, T277I/G395D/R415A/G418D/A432V, E315G, E315G/R415A/G418D/A432V, G395D/G418D, R415A/L417G/G418D, R415A/L417V, R415A/L417V/G418D, R415A/L417V/G418D/A432V, R415S, R415S/L417I/K443M, R415S/L417V, R415S/L417V/K443M, R415S/K443M, L417V, and K443M, wherein the positions are numbered with reference to SEQ ID NO: 6.

In some embodiments, the engineered transaminase polypeptides show increased activity in the conversion of substrate compounds (e.g., compound (2)) to the amino product compounds (e.g., compound (3)) in stereomeric excess in a defined time with the same amount of enzyme as compared to the wild-type or the reference engineered transaminase of SEQ ID NO: 4. In some embodiments, the engineered transaminase polypeptide has at least about 1.2 fold, 1.5 fold, 2 fold, 3 fold, 4 fold, 5 fold, 10 fold, 20 fold, 30 fold, 40 fold, or 50 fold or more the activity as compared to the reference engineered polypeptide represented by SEQ ID NO:4 under suitable reaction conditions.

In some embodiments, the engineered transaminase polypeptides have increased stability to temperature and/or solvents used in the conversion reaction as compared to the wild-type or a reference engineered enzyme. In some embodiments, the engineered transaminase polypeptide has at least 1.2 fold, 1.5 fold, 2 fold, 3 fold, 4 fold, 5 fold, 10 fold or more the stability as compared to the reference polypeptide of SEQ ID NO: 4 under suitable reaction conditions.

In some embodiments, the engineered transaminase polypeptides have increased tolerance to the ketone substrate of compound (2) as compared to the wild-type or a reference engineered enzyme. In some embodiments, the engineered transaminase polypeptide has at least 1.2 fold, 1.5 fold, 2 fold, 3 fold, 4 fold, 5 fold, or more increased tolerance to the substrate of compound (2), as compared to the polypeptide represented by SEQ ID NO:4 under suitable reaction conditions, as further described below.

In some embodiments, the engineered transaminase polypeptides have increased refractoriness or resistance to inhibition by product chiral amine of compound (3) as compared to the wild-type or a reference engineered enzyme. In some embodiments, the engineered transaminase polypeptide has at least 1.2 fold, 1.5 fold, 2 fold, 3 fold, 4 fold, 5 fold, or more increased resistance to inhibition by the product of compound (3), as compared to the polypeptide represented by SEQ ID NO:4 under suitable reaction conditions, as further described below.

In some embodiments, the engineered transaminase polypeptides are capable of converting the substrate of compound (2) to compound (3) in stereomeric excess of greater than 90%, 91%, 92%, 93%, 94%, 95%, 96%, 97%, 98%, 99%, 99.5% or greater under suitable reaction conditions (i.e., excess over other stereomeric product compounds having the opposite enantiomer at the chiral amine center).

In some embodiments, the engineered transaminase polypeptides are capable of converting substrate compound (2) to product compound (3) with increased tolerance for the presence of substrate relative to the reference polypeptide of SEQ ID NO: 4 under suitable reaction conditions. Thus, in some embodiments the engineered transaminase polypeptides are capable of converting the substrate compound (2) to product compound (3) under a substrate loading concentration of at least about 1 g/L, about 5 g/L, about 10 g/L, about 20 g/L, about 30 g/L, about 40 g/L, about 50 g/L, about 70 g/L, about 100 g/L, about 125 g/L, about 150 g/L about 175 g/L or about 200 g/L or more with a percent conversion of at least about at least about 50%, at least about 60%, at least about 70%, at least about 80%, at least about 90%, at least about 95%, at least about 98%, or at least about 99%, in a reaction time of about 72 h or less, about 48 h or less, about 36 h or less, or about 24 h less, under suitable reaction conditions.

In some embodiments, the present disclosure also provides engineered transaminase polypeptides that comprise a fragment of any of the engineered polypeptides described herein that retains the functional activity and/or improved property of that engineered transaminase. Accordingly, in some embodiments, the present disclosure provides a polypeptide fragment having transaminase activity, such as in converting compound (2) to compound (3) under suitable reaction conditions, wherein the fragment comprises at least about 80%, 90%, 95%, 96%, 97%, 98%, or 99% of a full-length amino acid sequence of an engineered transaminase polypeptide of the present disclosure, such as an exemplary engineered transaminase polypeptide selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, and 358.

In some embodiments, the engineered transaminase polypeptide can have an amino acid sequence comprising a deletion of any one of the engineered transaminase polypeptides described herein, such as the exemplary engineered polypeptides of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, and 358. Thus, for each and every embodiment of the engineered transaminase polypeptides of the disclosure, the amino acid sequence can comprise deletions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 10% of the total number of amino acids, up to 20% of the total number of amino acids, or up to 30% of the total number of amino acids of the transaminase polypeptides, where the associated functional activity and/or improved properties of the engineered transaminase described herein is maintained. In some embodiments, the deletions can comprise 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, or 25 amino acid residues.

In some embodiments, the engineered transaminase polypeptide herein can have an amino acid sequence comprising an insertion as compared to any one of the engineered transaminase polypeptides described herein, such as the exemplary engineered polypeptides of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, and 358. Thus, for each and every embodiment of the transaminase polypeptides of the disclosure, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, 20 or more amino acids, 30 or more amino acids, 40 or more amino acids, or 50 or more amino acids, where the associated functional activity and/or improved properties of the engineered transaminase described herein is maintained. The insertions can be to amino or carboxy terminus, or internal portions of the transaminase polypeptide.

In some embodiments, the engineered transaminase polypeptide herein can have an amino acid sequence comprising a sequence selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, and 358, and optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In some embodiments, the present disclosure provides an engineered polypeptide having transaminase activity, which polypeptide comprises an amino acid sequence having at least 80%, 85%, 86%, 87%, 88%, 89%, 90%, 91%, 92%, 93%, 94%, 95%, 96%, 97%, 98%, or 99% identity to a sequence selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, and 358, with the proviso that the amino acid sequence is not identical to (that is, it excludes) any of the exemplary engineered transaminase polypeptide amino acid sequences disclosed in U.S. Pat. Nos. 8,470,564, 9,029, 106, 9,512,410, 9,944,909, 10,323,233, 10,550,370, 8,852, 900 and 8,932,838; Yun et al., 2005, Appl Environ Micriobiol., 71(8):4220-4224); and Cho et al., 2008, Biotechnol Bioeng. 99(2):275-84; all of which are incorporated by reference herein.

In the above embodiments, the suitable reaction conditions for the engineered polypeptides can be those described in Tables 5.1 and 6.1, the Examples, and elsewhere herein. The suitable reaction conditions under which the above-described improved properties of the engineered polypeptides carry out the conversion can be determined with respect to concentrations or amounts of polypeptide, substrate, cofactor, buffer, co-solvent, pH, and/or conditions including temperature and reaction time, as further described below and in the Examples.

In some embodiments, the polypeptides of the disclosure can be in the form of fusion polypeptides in which the engineered polypeptides are fused to other polypeptides, such as, by way of example and not limitation, antibody tags (e.g., myc epitope), purification sequences (e.g., His tags for binding to metals), and cell localization signals (e.g., secretion signals). Thus, the engineered polypeptides described herein can be used with or without fusions to other polypeptides.

It is to be understood that the polypeptides described herein are not restricted to the genetically encoded amino acids. In addition to the genetically encoded amino acids, the polypeptides described herein may be comprised, either in whole or in part, of naturally-occurring and/or synthetic non-encoded amino acids. Certain commonly encountered non-encoded amino acids of which the polypeptides described herein may be comprised include, but are not limited to: the D-stereomers of the genetically-encoded amino acids; 2,3-diaminopropionic acid (Dpr); α-aminoisobutyric acid (Aib); s-aminohexanoic acid (Aha); 3-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutanic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aOly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (see, e.g., the various amino acids provided in Fasman, 1989, CRC Practical Handbook of Biochemistry and Molecular Biology, CRC Press, Boca Raton, FL, at pp. 3-70 and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys(methylbenzyl), Cys (nitropyridinesulfenyl), Glu(6-benzylester), Gln(xanthyl), Asn(N-δ-xanthyl), His(bom), His (benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered transaminase polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered polypeptides having transaminase activity of the present disclosure can be immobilized on a solid support such that they retain their improved activity, stereoselectivity, and/or other improved properties relative to the reference polypeptide of SEQ ID NO: 4. In such embodiments, the immobilized polypeptides can facilitate the biocatalytic conversion of the substrate compounds such as compound (2) or other suitable substrates, to the product compound of compound (3), or corresponding product (e.g., as shown in Scheme 4 described herein), and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the engineered transaminase polypeptides of the present disclosure can be carried out using the same engineered transaminase polypeptides bound or immobilized on a solid support.

Methods of enzyme immobilization are well-known in the art. The engineered transaminase polypeptide can be bound non-covalently or covalently. Various methods for conjugation and immobilization of enzymes to solid supports (e.g., resins, membranes, beads, glass, etc.) are well known in the art and described in e.g.: Yi et al., "Covalent immobilization of ω-transaminase from *Vibrio fluvialis* JS17 on chitosan beads," Process Biochemistry 42(5): 895-898 (May 2007); Martin et al., "Characterization of free and immobilized (S)-aminotransferase for acetophenone production," *Applied Microbiology and Biotechnology* 76(4): 843-851 (September 2007); Koszelewski et al., "Immobilization of ω-transaminases by encapsulation in a sol-gel/celite matrix," *Journal of Molecular Catalysis B: Enzymatic,* 63: 39-44 (April 2010); Truppo et al., "Development of an Improved Immobilized CAL-B for the Enzymatic Resolution of a Key Intermediate to Odanacatib," *Organic Process Research & Development*, published online: dx.doi.org/10.1021/op200157c; Hermanson, G. T., Bioconjugate Techniques, Second Edition, Academic Press (2008); Mateo et al., "Epoxy sepabeads: a novel epoxy support for stabilization of industrial enzymes via very intense multipoint covalent attachment," *Biotechnology Progress* 18(3):629-34 (2002); and Bioconjugation Protocols: Strategies and Methods, In Methods in Molecular Biology, C. M. Niemeyer ed., Humana Press (2004); the disclosures of each which are incorporated by reference herein. Solid supports useful for immobilizing the engineered transaminases of the present disclosure include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered transaminases of the present disclosure include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the engineered polypeptides can be in various forms, for example, such as an isolated preparation, as a substantially purified enzyme, whole cells transformed with gene(s) encoding the enzyme, and/or as cell extracts and/or lysates of such cells. The enzymes can be lyophilized, spray-dried, precipitated or be in the form of a crude paste, as further discussed below.

In some embodiments, the polypeptide described herein can be provided in the form of kits. The enzymes in the kits may be present individually or as a plurality of enzymes. The kits can further include reagents for carrying out the enzymatic reactions, substrates for assessing the activity of enzymes, as well as reagents for detecting the products. The kits can also include reagent dispensers and instructions for use of the kits.

In some embodiments, the polypeptides can be provided on the solid support in the form of an array in which the polypeptides are arranged in positionally distinct locations. The array can be used to test a variety of substrate compounds for conversion by the polypeptides. A plurality of supports can be configured on an array at various locations, addressable for robotic delivery of reagents, or by detection methods and/or instruments. Various methods for conjugation to substrates, e.g., membranes, beads, glass, etc. are described in, among others, Hermanson, G. T., Bioconjugate Techniques, $2^{nd}$ Edition, Academic Press; (2008), and Bioconjugation Protocols: Strategies and Methods, In Methods in Molecular Biology, C. M. Niemeyer ed., Humana Press (2004); the disclosures of which are incorporated herein by reference.

In some embodiments, the kits of the present disclosure include arrays comprising a plurality of different engineered transaminase polypeptides disclosed herein at different addressable position, wherein the different polypeptides are different variants of a reference sequence each having at least one different improved enzyme property. Such arrays comprising a plurality of engineered polypeptides and methods of their use are described in U.S. Pat. No. 9,228,223.

5.4 Polynucleotides Encoding Engineered Polypeptides, Expression Vectors and Host Cells In another aspect, the present disclosure provides polynucleotides encoding the engineered transaminase polypeptides described herein. The polynucleotides may be operatively linked to one or more heterologous regulatory sequences that control gene expression to create a recombinant polynucleotide capable of expressing the polypeptide. Expression constructs containing a heterologous polynucleotide encoding the engineered transaminase can be introduced into appropriate host cells to express the corresponding transaminase polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the improved transaminase enzymes. Thus, having knowledge of a particular amino acid sequence, those skilled in the art could make any number of different nucleic acids by simply modifying the sequence of one or more codons in a way which does not change the amino acid sequence of the protein. In this regard, the present disclosure specifically contemplates each and every possible variation of polynucleotides that could be made encoding the polypeptides described herein by selecting combinations based on the possible codon choices, and all such variations are to be considered specifically disclosed for any polypeptide described herein, including the amino acid sequences presented in Tables 5.1 and 6.1, and disclosed in the sequence listing incorporated by reference herein as SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, and 358.

In various embodiments, the codons are preferably selected to fit the host cell in which the protein is being produced. For example, preferred codons used in bacteria are used for expression in bacteria; preferred codons used in yeast are used for expression in yeast; and preferred codons used in mammals are used for expression in mammalian cells. In some embodiments, all codons need not be replaced to optimize the codon usage of the transaminases since the natural sequence will comprise preferred codons and because use of preferred codons may not be required for all amino acid residues. Consequently, codon optimized polynucleotides encoding the transaminase enzymes may contain preferred codons at about 40%, 50%, 60%, 70%, 80%, or greater than 90% of codon positions of the full length coding region.

In some embodiments, as described above, the polynucleotide encodes an engineered polypeptide having transaminase activity with the properties disclosed herein, such as the ability to convert substrate compound (2) to product compound (3), where the polypeptide comprises an amino acid sequence having at least 80%, 85%, 86%, 87%, 88%, 89%, 90%, 91%, 92%, 93%, 94%, 95%, 96%, 97%, 98%, 99% or more identity to a reference sequence selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, and 358, and one or more residue differences as compared to the reference polypeptide. In some embodiments, the reference sequence is selected from SEQ ID NO: 4 and/or 6. In some embodiments, the reference sequence is SEQ ID NO: 4. In some embodiments, the reference sequence is SEQ ID NO: 6.

In some embodiments, the polynucleotide encoding the engineered transaminase comprises a polynucleotide sequence selected from SEQ ID NO: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, and/or 357.

In some embodiments, the polynucleotides are capable of hybridizing under highly stringent conditions to a reference polynucleotide sequence selected from SEQ ID NO: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, and/or 357, or a complement thereof, and encodes a polypeptide having transaminase activity with one or more of the improved properties described herein.

In some embodiments, the polynucleotides encode the polypeptides described herein but have about 80% or more sequence identity, about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered transaminase. In some embodiments, the reference polynucleotide sequence is selected from SEQ ID NO: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, and/or 357.

An isolated polynucleotide encoding any of the engineered transaminase polypeptides herein may be manipulated in a variety of ways to provide for expression of the polypeptide. In some embodiments, the polynucleotides encoding the polypeptides can be provided as expression vectors where one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art. Guidance is provided in Sambrook et al., 2001, Molecular Cloning: A Laboratory Manual, 3rd Ed., Cold Spring Harbor Laboratory Press; and Current Protocols in Molecular Biology, Ausubel. F. ed., Greene Pub. Associates, 1998, updates to 2006.

In some embodiments, the control sequences include among others, promoter, leader sequence, polyadenylation sequence, propeptide sequence, signal peptide sequence, and transcription terminator. Suitable promoters can be selected based on the host cells used. For bacterial host cells, suitable promoters for directing transcription of the nucleic acid constructs of the present disclosure, include the promoters obtained from the *E. coli* lac operon, *Streptomyces coelicolor* agarase gene (dagA), *Bacillus subtilis* levansucrase gene (sacB), *Bacillus lichenformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (Villa-Kamaroff et al., 1978, Proc. Natl Acad. Sci. USA 75: 3727-3731), as well as the tac promoter (DeBoer et al., 1983, Proc. Natl Acad. Sci. USA 80: 21-25). Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are described by Romanos et al., 1992, Yeast 8:423-488.

The control sequence may also be a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice may be used in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are described by Romanos et al., 1992, supra.

The control sequence may also be a suitable leader sequence, a nontranslated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells can be from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are described by Guo and Sherman, 1995, Mol Cell Bio 15:5983-5990.

The control sequence may also be a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. Any signal peptide coding region which directs the expressed polypeptide into the secretory pathway of a host cell of choice may be used for expression of the engineered polypeptides. Effective signal peptide coding regions for bacterial host cells are the signal peptide coding regions obtained from the genes for *Bacillus* NCIB 11837 maltogenic amylase, *Bacillus stearothermophilus* alpha-amylase, *Bacillus licheniformis* subtilisin, *Bacillus lichenformis* beta-lactamase, *Bacillus stearothermophilus* neutral proteases (nprT, nprS, nprM), and *Bacillus subtilis* prsA. Further signal peptides are described by Simonen and Palva, 1993, Microbiol Rev 57:109-137. Effective signal peptide coding regions for filamentous fungal host cells can be the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells can be from the genes for *Saccharomyces cerevisiae* alpha-factor and *Saccharomyces cerevisiae* invertase.

The control sequence may also be a propeptide coding region that codes for an amino acid sequence positioned at the amino terminus of a polypeptide. The resultant polypeptide is referred to as a proenzyme or propolypeptide (or a zymogen in some cases). A propolypeptide can be converted to a mature active polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

It may also be desirable to add regulatory sequences, which allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include the lac, tac, and trp operator systems. In yeast host cells, suitable regulatory systems include, as examples, the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter.

In another aspect, the present disclosure is also directed to a recombinant expression vector comprising a polynucleotide encoding an engineered transaminase polypeptide, and one or more expression regulating regions such as a promoter and a terminator, a replication origin, etc., depending on the type of hosts into which they are to be introduced. The various nucleic acid and control sequences described above may be joined together to produce a recombinant expression vector which may include one or more convenient restriction sites to allow for insertion or substitution of the nucleic acid sequence encoding the polypeptide at such sites. Alternatively, the nucleic acid sequence of the present disclosure may be expressed by inserting the nucleic acid sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), which can be conveniently subjected to recombinant DNA procedures and can bring about the expression of the polynucleotide sequence. The choice of the vector will typically depend on the compatibility of the vector with the host cell into which the vector is to be introduced. The vectors may be linear or closed circular plasmids.

The expression vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The expression vector preferably contains one or more selectable markers, which permit easy selection of transformed cells. A selectable marker is a gene the product of which provides for biocide or viral resistance, resistance to heavy metals, prototrophy to auxotrophs, and the like. Examples of bacterial selectable markers are the dal genes from *Bacillus subtilis* or *Bacillus* lichenformis, or markers, which confer antibiotic resistance such as ampicillin, kanamycin, chloramphenicol (Example 1) or tetracycline resistance. Suitable markers for yeast host cells are ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Embodiments for use in an *Aspergillus* cell include the amdS and pyrG genes of *Aspergillus nidulans* or *Aspergillus oryzae* and the bar gene of *Streptomyces hygroscopicus.*

In another aspect, the present disclosure provides a host cell comprising a polynucleotide encoding an engineered transaminase polypeptide of the present disclosure, the polynucleotide being operatively linked to one or more control sequences for expression of the transaminase enzyme in the host cell. Host cells for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. An exemplary host cells are *Escherichia coli* W3110 (ΔfhuA) and BL21.

Accordingly, in another aspect, the present disclosure provides methods of manufacturing the engineered transaminase polypeptides, where the method can comprise culturing a host cell capable of expressing a polynucleotide encoding the engineered transaminase polypeptide under conditions suitable for expression of the polypeptide. The method can further comprise isolated or purifying the expressed transaminases polypeptide, as described herein.

Appropriate culture mediums and growth conditions for the above-described host cells are well known in the art. Polynucleotides for expression of the transaminase may be introduced into cells by various methods known in the art. Techniques include, among others, electroporation, biolistic particle bombardment, liposome mediated transfection, calcium chloride transfection, and protoplast fusion.

For the embodiments herein, the engineered polypeptides and corresponding polynucleotides can be obtained using methods used by those skilled in the art. The parental polynucleotide sequence encoding the wild-type polypeptide of *Vibrio fluvialis* is described in Shin et al., 2003, Appl. Microbiol. Biotechnol. 61(5-6):463-471, and methods of generating engineered transaminase polypeptides with improved stability and substrate recognition properties are disclosed in patent application publications U.S. Pat. Nos. 8,470,564, 9,029,106, 9,512,410, 9,944,909, 10,323,233, and 10,550,370, 8,852,900, 8,932,838, incorporated herein by reference.

The engineered transaminases with the properties disclosed herein can be obtained by subjecting the polynucleotide encoding the naturally occurring or engineered transaminase to mutagenesis and/or directed evolution methods, as discussed above. For example, mutagenesis and directed evolution methods can be readily applied to polynucleotides to generate variant libraries that can be expressed, screened, and assayed. Mutagenesis and directed evolution methods are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related non-US counterparts; Ling et al., Anal. Biochem., 254(2): 157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference). All publications are incorporated herein by reference.

The clones obtained following mutagenesis treatment can be screened for engineered transaminases having a desired improved enzyme property. For example, where the improved enzyme property desired is thermostability, enzyme activity may be measured after subjecting the enzyme preparations to a defined temperature and measuring the amount of enzyme activity remaining after heat treatments. Clones containing a polynucleotide encoding a transaminase are then isolated, sequenced to identify the nucleotide sequence changes (if any), and used to express the enzyme in a host cell. Measuring enzyme activity from the expression libraries can be performed using the standard biochemistry techniques, such as HPLC analysis following derivatization, e.g., with OPA, of the product amine.

Where the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides disclosed herein can be prepared by chemical synthesis using, e.g., the classical phosphoramidite method described by Beaucage et al., 1981, Tet Lett 22:1859-69, or the method described by Matthes et al., 1984, EMBO J. 3:801-05, e.g., as it is typically practiced in automated synthetic methods. According to the phosphoramidite method, oligonucleotides are synthesized, e.g., in an automatic DNA synthesizer, purified, annealed, ligated and cloned in appropriate vectors.

Accordingly, in some embodiments, a method for preparing the engineered transaminase polypeptide can comprise: (a) synthesizing a polynucleotide encoding a polypeptide comprising an amino acid sequence selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, and 358 and having one or more residue differences as compared to SEQ ID NO: 4.

In some embodiments of the method, the amino acid sequence encoded by the polynucleotide can optionally have one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

The expressed engineered transaminase can be measured for the desired improved property, e.g., activity, enantioselectivity, stability, and product tolerance, in the conversion of compound (2) to compound (3) by any of the assay conditions described herein.

In some embodiments, any of the engineered transaminase enzymes expressed in a host cell can be recovered from the cells and or the culture medium using any one or more of the well-known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are provided in the Examples, and also commercially available, e.g., CelLytic B™ from Sigma-Aldrich of St. Louis MO.

Chromatographic techniques for isolation of the transaminase polypeptide include, among others, reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., and will be apparent to those having skill in the art.

In some embodiments, affinity techniques may be used to isolate the improved transaminase enzymes. For affinity chromatography purification, any antibody which specifically binds the transaminase polypeptide may be used. For the production of antibodies, various host animals, including but not limited to rabbits, mice, rats, etc., may be immunized by injection with a transaminase polypeptide, or a fragment thereof. The transaminase polypeptide or fragment may be attached to a suitable carrier, such as BSA, by means of a side chain functional group or linkers attached to a side chain functional group.

5.7 Methods of Using the Engineered Transaminase Enzymes

As noted above, the engineered transaminase polypeptides of the present disclosure were evolved to efficiently convert the ketone of the exemplary substrate compound (2) to the corresponding chiral amine of the exemplary product compound (3) in stereomeric excess, in the presence of an amino donor under suitable reaction conditions. The structural features of the engineered transaminase polypeptides also allow for the conversion of prochiral ketone substrate compounds, other than compound (2), to their corresponding chiral amine compounds in stereomeric excess. Accordingly, in another aspect, the present disclosure provides processes using the engineered transaminase polypeptides to carry out a transamination reaction in which an amino group from an amino donor is transferred to an amino acceptor, e.g., a ketone substrate compound, to produce an amine compound. Generally, the process for performing the transamination reaction comprises contacting or incubating an engineered transaminase polypeptide of the disclosure with an amino acceptor (e.g., a ketone substrate compound) and an amino donor (e.g., isopropylamine) with under reaction conditions suitable for converting the amino acceptor to an amine compound.

For the foregoing processes, any of the engineered transaminase polypeptides described herein can be used. By way of example and without limitation, in some embodiments, the process can use an engineered polypeptide having transaminase activity of the present disclosure comprises an amino acid sequence having at least 80%, 85%, 86%, 87%, 88%, 89%, 90%, 91%, 92%, 93%, 94%, 95%, 96%, 97%, 98%, 99% or more identity to a reference sequence selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, and 358, and one or more residue differences as compared to SEQ ID NO: 4.

In some embodiments, exemplary transaminase polypeptides capable of carrying out the processes herein can be a polypeptide comprising an amino acid sequence selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, and 358. Guidance on the choice and use of the engineered transaminase polypeptides is provided in the descriptions herein, for example Tables 5.1 and 6.1 and the Examples.

In the embodiments herein and illustrated in the Examples, various ranges of suitable reaction conditions that can be used, including but not limited, to ranges of amino donor, pH, temperature, buffer, solvent system, substrate loading, polypeptide loading, cofactor loading, pressure, and reaction time. Further suitable reaction conditions for carrying out the process for biocatalytic conversion of substrate compounds to product compounds using an engineered transaminase polypeptide described herein can be readily optimized in view of the guidance provided herein by routine experimentation that includes, but is not limited to, contacting the engineered transaminase polypeptide and substrate compound under experimental reaction conditions of concentration, pH, temperature, solvent conditions, and detecting the product compound.

In some embodiments herein, the transaminase polypeptide uses an amino donor to form the product compounds. In some embodiments, the amino donor in the reaction condition can be selected from isopropylamine (also referred to herein as "IPM"), putrescine, L-lysine, α-phenethylamine, D-alanine, L-alanine, or D,L-alanine, or D,L-ornithine. In some embodiments, the amino donor is selected from IPM, putrescine, L-lysine, D- or L-alanine. In some embodiments, the amino donor is IPM. In some embodiments, the suitable reaction conditions comprise the amino donor, in particular IPM, present at a concentration of at least about 0.1 to about 3 M, 0.2 to about 2.5 M, about 0.5 to about 2 M or about 1 to about 2 M. In some embodiments, the amino donor is present at a concentration of about 0.1, 0.2, 0.3, 0.4, 0.5, 0.6, 0.7, 0.8, 1, 1.5, 2, 2.5 or 3 M. Higher concentrations of amino donor, e.g., IPM, can be used to shift the equilibrium towards amine product formation.

Suitable reaction conditions using the engineered transaminase polypeptides also typically comprise a cofactor. Cofactors useful for transaminase enzymes herein include, but are not limited to, pyridoxal-5'-phosphate (also known as pyridoxal-phosphate, PLP, P5P), pyridoxine (PN), pyridoxal (PL), pyridoxamine (PM), and their phosphorylated counterparts pyridoxine phosphate (PNP) and pyridoxamine phosphate (PMP). In some embodiments, the cofactor PLP is present naturally in the cell extract and does not need to be supplemented. In some embodiments of the processes, the suitable reaction conditions comprise exogenous cofactor added to the enzyme reaction mixture, for example, when using partially purified or purified transaminase enzyme. In some embodiments, the suitable reaction conditions can comprise the presence of a cofactor selected from PLP, PN, PL, PM, PNP, and PMP, at a concentration of about 0.1 g/L to about 10 g/L, about 0.2 g/L to about 5 g/L, about 0.5 g/L to about 2.5 g/L. In some embodiments, the reaction conditions comprise a PLP concentration of about 0.1 g/L or less, 0.2 g/L or less, 0.5 g/L or less, 1 g/L or less, 2.5 g/L or less, 5 g/L or less, or 10 g/L or less. In some embodiments, the cofactor can be added either at the beginning of the reaction and/or additional cofactor is added during the reaction.

Substrate compound in the reaction mixtures can be varied, taking into consideration, for example, the desired amount of product compound, the effect of substrate concentration on enzyme activity, stability of enzyme under reaction conditions, and the percent conversion of substrate to product. In some embodiments, the suitable reaction conditions comprise a substrate compound loading of at least about 0.5 to about 200 g/L, 1 to about 200 g/L, about 5 to about 150 g/L, about 10 to about 100 g/L, about 20 to about 100 g/L, or about 50 to about 100 g/L. In some embodiments, the suitable reaction conditions comprise a substrate compound loading of at least about 0.5 g/L, at least about 1 g/L, at least about 5 g/L, at least about 10 g/L, at least about 15 g/L, at least about 20 g/L, at least about 30 g/L, at least about 50 g/L, at least about 75 g/L, at least about 100 g/L, at least about 150 g/L or at least about 200 g/L, or even greater. The values for substrate loadings provided herein are based on the molecular weight of compound (2), however it also contemplated that the equivalent molar amounts of various hydrates and salts of compound (2) also can be used in the process.

In carrying out the reactions described herein, the engineered transaminase polypeptide may be added to the reaction mixture in the form of a purified enzyme, whole cells transformed with gene(s) encoding the enzyme, and/or as cell extracts and/or lysates of such cells. Whole cells transformed with gene(s) encoding the engineered transaminase enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (ammonium sulfate, polyethyleneimine, heat treatment or the like), followed by a desalting procedure prior to lyophilization (e.g., ultrafiltration, dialysis, and the like). Any of the cell preparations may be stabilized by crosslinking using known crosslinking agents, such as, for example, glutaraldehyde, or immobilization to a solid phase (e.g., Eupergit C, and the like).

The gene(s) encoding the engineered transaminase polypeptides can be transformed into host cell separately or together into the same host cell. For example, in some embodiments one set of host cells can be transformed with gene(s) encoding one engineered transaminase polypeptide and another set can be transformed with gene(s) encoding another engineered transaminase polypeptide. Both sets of transformed cells can be utilized together in the reaction mixture in the form of whole cells, or in the form of lysates or extracts derived therefrom. In other embodiments, a host cell can be transformed with gene(s) encoding multiple engineered transaminase polypeptide. In some embodiments the engineered polypeptides can be expressed in the form of secreted polypeptides and the culture medium containing the secreted polypeptides can be used for the transaminase reaction.

The enhancements in activity and/or stereoselectivity of the engineered transaminase polypeptides disclosed herein provide for processes wherein higher percentage conversion can be achieved with lower concentrations of the engineered polypeptide. In some embodiments of the process, the suitable reaction conditions comprise an engineered polypeptide concentration of about 0.01 to about 50 g/L; about 0.05 to about 50 g/L; about 0.1 to about 40 g/L; about 1 to about 40 g/L; about 2 to about 40 g/L; about 5 to about 40 g/L; about 5 to about 30 g/L; about 0.1 to about 10 g/L; about 0.5 to about 10 g/L; about 1 to about 10 g/L; about 0.1 to about 5 g/L; about 0.5 to about 5 g/L; or about 0.1 to about 2 g/L. In some embodiments, the transaminase polypeptide is concentration at about 0.01, 0.05, 0.1, 0.2, 0.5, 1, 2, 5, 10, 15, 20, 25, 30, 35, 40, or 50 g/L.

During the course of the transamination reactions, the pH of the reaction mixture may change. The pH of the reaction mixture may be maintained at a desired pH or within a desired pH range. This may be done by adding an acid or base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, carbonate, phosphate, triethanolamine (TEA), and the like. In some embodiments, the buffer is borate. In some embodiments of the process, the suitable reaction conditions comprise a buffer solution of TEA, where the TEA concentration is from about 0.01 to about 0.4 M, 0.05 to about 0.4 M, 0.1 to about 0.3 M, or about 0.1 to about 0.2 M. In some embodiments, the reaction condition comprises a TEA concentration of about 0.01, 0.02, 0.03, 0.04, 0.05, 0.07, 0.1, 0.12, 0.14, 0.16, 0.18, 0.2, 0.3, or 0.4 M. In some embodiments, the reaction conditions comprise water as a suitable solvent with no buffer present.

In the embodiments of the process, the reaction conditions can comprise a suitable pH. The desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH from about 6 to about 12, pH from about 6 to about 10, pH from about 6 to about 8, pH from about 7 to about 10, pH from about 7 to about 9, or pH from about 7 to about 8. In some embodiments, the reaction conditions comprise a solution pH of about 6, 6.5, 7, 7.5, 8, 8.5, 9, 9.5, 10, 10.5, 11, 11.5 or 12.

In the embodiments of the processes herein, a suitable temperature can be used for the reaction conditions, for example, taking into consideration the increased reaction rate at higher temperatures, and the activity of the enzyme during the reaction time period. For example, the engineered polypeptides of the present disclosure have increased stability relative to naturally occurring transaminase polypeptide e.g., the wild-type polypeptide of SEQ ID NO: 2 or an engineered variant of the wild-type polypeptide, which allow the engineered polypeptides to be used at higher temperatures for increased conversion rates and improved substrate solubility characteristics. Accordingly, in some embodiments, the suitable reaction conditions comprise a temperature of about 10° C. to about 70° C., about 10° C. to about 65° C., about 15° C. to about 60° C., about 20° C. to about 60° C., about 20° C. to about 55° C., about 30° C. to about 55° C., or about 40° C. to about 50° C. In some embodiments, the suitable reaction conditions comprise a temperature of about 10° C., 15° C., 20° C., 25° C., 30° C., 35° C., 40° C., 45° C., 50° C., 55° C., 60° C., 65° C., or 70° C. In some embodiments, the temperature during the enzymatic reaction can be maintained at a temperature throughout the course of the reaction or adjusted over a temperature profile during the course of the reaction.

The processes herein are generally carried out in a solvent. Suitable solvents include water, aqueous buffer solutions, organic solvents, polymeric solvents, and/or co-solvent systems, which generally comprise aqueous solvents, organic solvents and/or polymeric solvents. The aqueous solvent (water or aqueous co-solvent system) may be pH-buffered or unbuffered. In some embodiments, the processes are generally carried out in an aqueous co-solvent system comprising an organic solvent (e.g., ethanol, isopropanol (IPA), dimethyl sulfoxide (DMSO), ethyl acetate, butyl acetate, 1-octanol, heptane, octane, methyl t-butyl ether (MTBE), toluene, and the like), ionic or polar solvents (e.g., 1 ethyl 4 methylimidazolium tetrafluoroborate, 1 butyl 3 methylimidazolium tetrafluoroborate, 1 butyl 3 methylimidazolium hexafluorophosphate, glycerol, polyethylene glycol, and the like). In some embodiments, the co-solvent can be a polar solvent, such as a polyol, dimethylsulfoxide, DMSO, or lower alcohol. The non-aqueous co-solvent component of an aqueous co-solvent system may be miscible with the aqueous component, providing a single liquid phase, or may be partly miscible or immiscible with the aqueous component, providing two liquid phases. Exemplary aqueous co-solvent systems can comprise water and one or more co-solvents selected from an organic solvent, polar solvent, and polyol solvent. In general, the co-solvent component of an aqueous co-solvent system is chosen such that it does not adversely inactivate the transaminase enzyme under the reaction conditions. Appropriate co-solvent systems can be readily identified by measuring the enzymatic activity of the specified engineered transaminase enzyme with a defined substrate of interest in the candidate solvent system, utilizing an enzyme activity assay, such as those described herein.

In some embodiments of the process, the suitable reaction conditions comprise an aqueous co-solvent, where the co-solvent comprises DMSO at about 1% to about 80% (v/v), about 1 to about 70% (v/v), about 2% to about 60% (v/v), about 5% to about 40% (v/v), 10% to about 40% (v/v), 10% to about 30% (v/v), or about 10% to about 20% (v/v). In some embodiments of the process, the suitable reaction conditions comprise an aqueous co-solvent comprising DMSO at least about 1%, 5%, 10%, 15%, 20%, 25%, 30%, 35%, 40%, 45%, 50%, 55%, 60%, 65%, 70%, 75%, or 80% (v/v). In some embodiments of the process, the suitable reaction conditions comprise an aqueous co-solvent comprising DMSO of from about 15% (v/v) to about 45% (v/v), from about 20% (v/v) to about 30% (v/v), and in some embodiments a DMSO concentration of about 25% (v/v).

In some embodiments of the process, the suitable reaction conditions comprise an aqueous co-solvent, where the co-solvent can comprise a polymeric polyol solvent. Examples of suitable polyol solvents include, by way of example and not limitation, polyethylene glycol, polyethylene glycol methyl ether, diethylene glycol dimethyl ether, triethylene glycol dimethyl ether, and polypropylene glycol. In some embodiments, the aqueous co-solvent comprises polyethylene glycol, which is available in different molecular weights. Particularly useful are lower molecular weight polyethylene glycols, such as PEG200 to PEG600. Accordingly, in some embodiments, the aqueous co-solvent can comprise PEG200 of about 1% to about 40% v/v; about 1% to about 40% v/v; about 2% to about 40% v/v; about 5% to about 40% v/v; 2% to about 30% v/v; 5% to about 30% v/v; 1 to about 20% v/v; about 2% to about 20% v/v; about 5% to about 20% v/v; about 1% to about 10% v/v; about 2% to about 10% v/v. In some embodiments, the suitable reaction conditions comprise an aqueous co-solvent comprising PEG200 at about 1%, 2%, 5%, 10%, 15%, 20%; 25%; 30%; 35%; 35% or about 40% v/v.

The quantities of reactants used in the transamination reaction will generally vary depending on the quantities of product desired, and concomitantly the amount of transaminase substrate employed. Those having ordinary skill in the art will readily understand how to vary these quantities to tailor them to the desired level of productivity and scale of production.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor, transaminase, and transaminase substrate may be added first to the solvent.

The solid reactants (e.g., enzyme, salts, substrate compounds, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

For improved mixing efficiency when an aqueous co-solvent system is used, the transaminase and cofactor may be added and mixed into the aqueous phase first. The organic phase may then be added and mixed in, followed by addition of the transaminase substrate. Alternatively, the transaminase substrate may be premixed in the organic phase, prior to addition to the aqueous phase.

The transamination reaction is generally allowed to proceed until further conversion of ketone substrate to amine product does not change significantly with reaction time, e.g., less than 10% of substrate being converted, or less than 5% of substrate being converted. In some embodiments, the reaction is allowed to proceed until there is complete or near complete conversion of substrate ketone to product amine. Transformation of substrate to product can be monitored using known methods by detecting substrate and/or product. Suitable methods include gas chromatography, HPLC, and the like. Conversion yields of the chiral amine product generated in the reaction mixture are generally greater than about 50%, may also be greater than about 60%, may also be greater than about 70%, may also be greater than about 80%, may also be greater than 90%, and may be greater than about 97%. In some embodiments, the methods for preparing compound (3) using an engineered transaminase polypeptide under suitable reaction conditions results in at least about 91%, 92%, 93%, 94%, 95%, 96%, 97%, 98%, 99% or greater conversion of ketone substrate, e.g, compound of compound (2), to the amine product compound, e.g., compound (3) in about 48h or less, in about 36 h or less, in about 24 h or less, or even less time.

In some embodiments of the process, the suitable reaction conditions comprise a substrate loading of at least about 20 g/L, 30 g/L, 40 g/L, 50 g/L, 60 g/L, 70 g/L, 100 g/L, or more, and wherein the process results in at least about 91%, 92%, 93%, 94%, 95%, 96%, 97%, 98%, 99% or greater conversion of substrate compound to product compound in about 48h or less, in about 36 h or less, or in about 24 h or less.

The engineered transaminase polypeptides of the present disclosure when used in the process for preparing chiral amine compound (3) under suitable reaction conditions result in a stereomeric excess of the chiral amine in at least 90%, 91%, 92%, 93%, 94%, 95% 97%, 98, 99%, 99.1%, 99.2%, 99.3%, 99.4%, 99.5%, 99.6%, 99.7%, 99.8%, or 99.9% e.e.

In a further embodiment of the processes, the suitable reaction conditions can comprise an initial substrate loading to the reaction solution which is then contacted by the polypeptide. This reaction solution is then further supplemented with additional substrate compound as a continuous addition over time at a rate of at least about 1 g/L/h, at least about 2 g/L/h, at least about 4 g/L/h, at least about 6 g/L/h, or higher. Thus, according to these suitable reaction conditions, polypeptide is added to a solution having an initial substrate loading of at least about 20 g/L, 30 g/L, or 40 g/L. This addition of polypeptide is then followed by continuous addition of further substrate to the solution at a rate of about 2 g/L/h, 4 g/L/h, or 6 g/L/h until a much higher final substrate loading of at least about 30 g/L, 40 g/L, 50 g/L, 60 g/L, 70 g/L, 100 g/L, 150 g/L, 200 g/L or more, is reached. Accordingly, in some embodiments of the process, the suitable reaction conditions comprise addition of the polypeptide to a solution having an initial substrate loading of at least about 20 g/L, 30 g/L, or 40 g/L followed by addition of further substrate to the solution at a rate of about 2 g/L/h, 4 g/L/h, or 6 g/L/h until a final substrate loading of at least about 30 g/L, 40 g/L, 50 g/L, 60 g/L, 70 g/L, 100 g/L or more, is reached. This substrate supplementation reaction condition allows for higher substrate loadings to be achieved while maintaining high rates of conversion of ketone substrate to amine product of at least about 91%, 92%, 93%, 94%, 95%, 96%, 97%, 98%, 99% or greater. In some embodiments of this process, the further substrate added is in a solution comprising isopropylamine or isopropylamine acetate at a concentration of at least about 0.5 M, at least about 1.0 M, at least about 2.5 M, at least about 5.0 M, at least about 7.5 M, at least about 10.0 M.

In some embodiments of the processes, the transamination reaction can comprise the following suitable reaction conditions (a) substrate loading at about 5 g/L to 200 g/L; (b) about 0.1 to 50 g/L of engineered transaminase polypeptide; (c) about 0.1 to 4 M of isopropylamine (IPM); (d) about 0.1 to 10 g/L of pyridoxal phosphate (PLP) cofactor; (e) pH of about 6 to 11; and (f) temperature of about 30 to 60° C.

In some embodiments of the processes, the transamination reaction can comprise the following suitable reaction conditions: (a) substrate loading at about 10 g/L to 150 g/L; (b) about 0.5 to 20 g/L of engineered transaminase polypeptide; (c) about 0.1 to 3 M of isopropylamine (IPM); (d) about 0.1 to 1.0 g/L of pyridoxal phosphate (PLP) cofactor; (e) about 0.05 to 0.1 M carbonate or boratebuffer; (f) about 1% to abut 45% DMSO; (g) pH of about 7.5 to 11; and (h) temperature of about 30 to 55° C.

In some embodiments of the processes, the transamination reaction can comprise the following suitable reaction conditions: (a) substrate loading at about 20 to 100 g/L; (b) about 1 to 5 g/L of engineered transaminase polypeptide; (c) about 0.5 to 2.5 M of isopropylamine (IPM); (d) about 0.2 to 2 g/L of pyridoxal phosphate (PLP) cofactor; (e) about 0.1 M borate buffer; (f) about 20% DMSO; (e) pH of about 10; and (f) temperature of about 45 to 60° C.

In some embodiments, additional reaction components or additional techniques carried out to supplement the reaction conditions. These can include taking measures to stabilize or prevent inactivation of the enzyme, reduce product inhibition, and/or shift reaction equilibrium to product amine formation.

Accordingly, in some embodiments of the process for preparing an amine, such as a chiral amine, additional quantities of the amino acceptor can be added (up to saturation) and/or the amino acceptor (ketone) formed can be continuously removed from the reaction mixture. For example, a solvent bridge or a two phase co-solvent system can be used to move the amine product to an extraction solution, and thereby reduce inhibition by amine product and also shift the equilibrium towards product formation (see, e.g., Yun and Kim, 2008, Biosci. Biotechnol. Biochem. 72(11):3030-3033).

In some embodiments of the processes, the suitable reaction conditions comprise the presence of the reduced cofactor, nicotinamide adenine dinucleotide (NADH), which can act to limit the inactivation of the transaminase enzyme (see e.g., van Ophem et al., 1998, Biochemistry 37(9):2879-88). In such embodiments where NADH is present, a cofactor regeneration system, such as glucose dehydrogenase (GDH) and glucose or formate dehydrogenase and formate can be used to regenerate the NADH in the reaction medium.

In some embodiments, the process can further comprise removal of the carbonyl by-product formed from the amino group donor when the amino group is transferred to the amino group acceptor. Such removal in situ can reduce the rate of the reverse reaction such that the forward reaction dominates and more substrate is then converted to product. Removal of the carbonyl by-product can be done in a number of ways. Where the amino group donor is an amino acid, such as alanine, the carbonyl by-product, a keto acid, can be removed by reaction with a peroxide (see, e.g., US 2008/0213845, incorporated herein by reference). Peroxides that can be used include, among others, hydrogen peroxide; peroxyacids (peracids), such as peracetic acid ($CH_3CO_3H$), trifluoroperacetic acid and metachloroperoxybenzoic acid; organic peroxides such as t-butyl peroxide ($(CH_3)_3COOH$); or other selective oxidants such as tetrapropylammonium perruthenate, $MnO_2$, $KMnO_4$, ruthenium tetroxide and related compounds. Alternatively, pyruvate removal can be achieved via its reduction to lactate by employing lactate dehydrogenase to shift equilibrium to the product amine (see, e.g., Koszelewski et al., 2008, Adv. Syn. Catal. 350: 2761-2766). Pyruvate removal can also be achieved via its decarboxylation by employing pyruvate decarboxylase (see, e.g., Höhne et al., 2008, Chem BioChem 9:363-365) or acetolactate synthase (see, e.g., Yun and Kim, supra).

Alternatively, in embodiments where an amino acid is used as amino group donor, the keto acid carbonyl by-product can be recycled back to the amino acid by reaction with ammonia and NADH using an appropriate dehydrogenase enzyme, e.g., amino acid dehydrogenase, in presence of an amine donor, such as ammonia, thereby replenishing the amino group donor.

In some embodiments, where the choice of the amino donor results in a carbonyl by-product that has a vapor pressure higher than water (e.g., a low boiling co-product such as a volatile organic carbonyl compound), the carbonyl by-product can be removed by sparging the reaction solution with a non-reactive gas or by applying a vacuum to lower the reaction pressure and removing the carbonyl by-product present in the gas phase. A non-reactive gas is any gas that does not react with the reaction components. Various non-reactive gases include nitrogen and noble gases (e.g., inert gases). In some embodiments, the non-reactive gas is nitrogen gas. In some embodiments, the amino donor used in the process is isopropylamine (IPM), which forms the carbonyl by-product acetone upon transfer of the amino group to the amino group acceptor. The acetone can be removed by sparging with nitrogen gas or applying a vacuum to the reaction solution and removing the acetone from the gas phase by an acetone trap, such as a condenser or other cold trap. Alternatively, the acetone can be removed by reduction to isopropanol using a transaminase.

In some embodiments of the process of preparing a chiral amine, a nitrogen sweep to remove acetone is utilized to increase conversion and yields of the chiral amine under industrial process conditions.

In some embodiments of the processes above where the carbonyl by-product is removed, the corresponding amino group donor can be added during the transamination reaction to replenish the amino group donor and/or maintain the pH of the reaction. Replenishing the amino group donor also shifts the equilibrium towards product formation, thereby increasing the conversion of substrate to product. Thus, in some embodiments wherein the amino group donor is isopropylamine and the acetone product is removed in situ, isopropylamine can be added to the solution to replenish the amino group donor lost during the acetone removal and to maintain the pH of the reaction.

In further embodiments, any of the above described process for the conversion of substrate compound to product compound can also comprise one or more steps selected from: extraction, isolation, purification, and crystallization of product compound. Methods, techniques, and protocols for extracting, isolating, purifying, and/or crystallizing the product amine from biocatalytic reaction mixtures produced by the above disclosed methods are known to the ordinary artisan and/or accessed through routine experimentation. Additionally, illustrative methods are provided in the Examples below.

Various features and embodiments of the disclosure are illustrated in the following representative examples, which are intended to be illustrative, and not limiting.

6. EXAMPLES

The following Examples, including experiments and results achieved, are provided for illustrative purposes only and are not to be construed as limiting the present invention. Indeed, there are various suitable sources for many of the reagents and equipment described below. It is not intended that the present invention be limited to any particular source for any reagent or equipment item.

In the experimental disclosure below, the following abbreviations apply: M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μ (micrometers); sec. (seconds); min(s) (minute(s)); h(s) and hr(s) (hour(s)); U (units); MW (molecular weight); rpm (rotations per minute); psi and PSI (pounds per square inch); ° C. (degrees Centigrade); RT and rt (room temperature); RH (relative humidity); CV (coefficient of variability); CAM and cam (chloramphenicol); PMBS (polymyxin B sulfate); IPTG (isopropyl β-D-1-thiogalactopyranoside); LB (Luria broth); TB (terrific broth); SFP (shake flask powder); CDS (coding sequence); DNA (deoxyribonucleic acid); RNA (ribonucleic acid); nt (nucleotide; polynucleotide); aa (amino acid; polypeptide); *E. coli* W3110 (commonly used laboratory *E. coli* strain, available from the *Coli* Genetic Stock Center [CGSC], New Haven, CT); HTP (high throughput); HPLC (high pressure liquid chromatography); HPLC-UV (HPLC-Ultraviolet Visible Detector); 1H NMR (proton nuclear magnetic resonance spectroscopy); FIOPC (fold improvements over positive control); Sigma and Sigma-Aldrich (Sigma-Aldrich, St. Louis, MO; Difco (Difco Laboratories, BD Diagnostic Systems, Detroit, MI); Microfluidics (Microfluidics, Westwood, MA); Life Technologies (Life Technologies, a part of Fisher Scientific, Waltham, MA); Amresco (Amresco, LLC, Solon, OH); Carbosynth (Carbosynth, Ltd., Berkshire, UK); Varian (Varian Medical Systems, Palo Alto, CA); Agilent (Agilent Technologies, Inc., Santa Clara, CA); Infors (Infors USA Inc., Annapolis Junction, MD); and Thermotron (Thermotron, Inc., Holland, MI).

Example 1: *E. coli* Expression Hosts Containing Recombinant Transaminase Genes The initial transaminase enzyme used to produce the variants of the present invention was SEQ ID NO: 4, cloned into the expression vector pCK110900 (See, FIG. 3 of US Pat. Appln. Publn. No. 2006/0195947), operatively linked to the lac promoter under control of the lacI repressor. The expression vector also contains the P15a origin of replication and the chloramphenicol (CAM) resistance gene. The resulting plasmids were transformed into *E. coli* W3110, using standard methods known in the art. The transformants were isolated by subjecting the cells to chloramphenicol selection, as known in the art (See e.g., U.S. Pat. No. 8,383,346 and WO2010/144103).

Example 2: Preparation of HTP Transaminase-Containing Wet Cell Pellets

*E. coli* cells containing recombinant transaminase-encoding genes from monoclonal colonies were inoculated into 180 μL LB containing 1% glucose and 30 μg/mL CAM in the wells of 96-well, shallow-well microtiter plates. The plates were sealed with $O_2$-permeable seals, and cultures were grown overnight at 30° C., 200 rpm, and 85% humidity. Then, 10 μL of each of the cell cultures were transferred into the wells of 96-well, deep-well plates containing 390 mL TB and 30 μg/mL CAM. The deep-well plates were sealed with $O_2$-permeable seals and incubated at 30° C., 250 rpm, and 85% humidity until $OD_{600}$ 0.6-0.8 was reached. The cell cultures were then induced by IPTG to a final concentration of 1 mM and incubated overnight under the same conditions as originally used. The cells were then pelleted using centrifugation at 4,000 rpm for 10 min. The supernatants were discarded, and the pellets were frozen at −80° C. prior to lysis.

Example 3: Preparation of HTP Transaminase-Containing Cell Lysates

First, 400 μl lysis buffer containing 100 mM triethanolamine buffer, pH 7.5, 0.5 mg/mL PLP, 1 mg/mL lysozyme, and 0.5 mg/mL PMBS were added to the cell paste in each well, produced as described in Example 2. The cells were lysed at room temperature for 2 hours with shaking on a bench top shaker. The plate was then centrifuged for 10 min at 4,000 rpm and 4° C. The clear supernatants were used in biocatalytic reactions to determine their activity levels.

Example 4: Preparation of Lyophilized Lysates from Shake Flask (SF) Cultures

Selected HTP cultures grown as described above were plated onto LB agar plates with 1% glucose and 30 μg/ml CAM and were grown overnight at 37° C. A single colony from each culture was transferred to 6 ml of LB with 1% glucose and 30 μg/ml CAM. The cultures were grown for 18 h at 30° C., 250 rpm, and sub-cultured approximately 1:50 into 250 ml of TB containing 30 μg/ml CAM, to a final $OD_{600}$ of 0.05. The cultures were grown for approximately 195 minutes at 30° C. and 250 rpm, to an $OD_{600}$ between 0.6-0.8 and induced with 1 mM IPTG. The cultures were then grown for 20 h at 30° C. and 250 rpm. The cultures were centrifuged at 4,000 rpm for 20 min. The supernatant was discarded, and the pellets were resuspended in 30 ml of 10 mM triethanolamine buffer, pH 7.5. The cells were pelleted (4,000 rpm for 20 min) and frozen at −80° C. for 120 minutes. Frozen pellets were resuspended in 30 ml of 10 mM triethanolamine buffer, pH 7.5, and lysed using a Microfluidizer system (Microfluidics) at 18,000 psi. The lysates were pelleted (10,000 rpm for 60 min), and the supernatants were frozen and lyophilized to generate shake flake (SF) enzymes.

Example 5: Improved Transaminase Activity over SEQ ID NO: 4 in the Production of Compound (3)

SEQ ID NO: 4 was selected as the parent enzyme after screening variants for the transamination of ketone substrate. Activity relative to SEQ ID NO: 4 (FIOP conversion) was calculated as the percent conversion of the product formed by the variant over the percent conversion produced by SEQ ID NO: 4 and shown in Table 5.1. The percent conversion was calculated by dividing the area of the product peak by the sum of the areas of the substrate and product peaks as observed by the HPLC-UV analysis (Example 7), and the enantioselectivity was confirmed using normal phase HPLC-UV analysis (Example 8).

The engineered polynucleotide (SEQ ID NO: 3) encoding the polypeptide with transaminase activity of SEQ ID NO: 4 was used to generate the engineered polypeptides of Table 5.1. These polypeptides displayed improved transaminase activity under the desired conditions (e.g., ketone substrate, compound (2), 1-imidazo[1,2-a]pyridin-6-ylethanone to product, compound (3), (1S)-1-imidazo[1,2-a]pyridin-6-ylethanamine) as compared to the starting polypeptide. The engineered polypeptides, having the amino acid sequences of even-numbered sequence identifiers were generated from the "backbone" amino acid sequence of SEQ ID NO: 4 as described, and identified using the HTP assay, described below, and analytical methods shown in Table 7.1.

Directed evolution began with the polynucleotide set forth in SEQ ID NO: 3. Libraries of engineered polypeptides were generated using various well-known techniques (e.g., saturation mutagenesis, recombination of previously identified beneficial amino acid differences) and screened using the HTP assay below and the analytical method described in Table 7.1.

The enzyme assay was carried out in a 96-well deep-well (2 mL) plates, in 100 μL total volume/well. The reactions were carried out using 15 μL HTP lysate, 30 g/L ketone substrate, 0.26 g/L PLP, 1M IPM, 20% (v/v) DMSO, 100 mM carbonate buffer, pH 10.0. The reactions were set up by adding the following: 1.) 20 μL of 150 g/L substrate ketone in DMSO 2.) 65 μL of a master mix solution containing 1.6 M IPM, pH 10.0, 160 mM carbonate buffer, pH 10.0 and 0.4 g/L PLP, 3) 15 μL of HTP lysate. The reaction plate was heat-sealed at 180° C. for 2s. The plates were then shaken at 600 rpm at 50° C. for 20 hours.

After the 20-hour incubation, 300 μL of acetonitrile were added into each well, and the plates were re-sealed and shaken for 10 minutes at room temperature followed by centrifuging at 4° C. for 10 min. In a new plate, 20 μL of the samples from the above plate were further diluted by adding 180 μL of 1:1 mixture of water:acetonitrile. The plates were sealed and mixed at room temperature for 1 min prior to achiral HPLC analysis as described in Example 7.

For chiral analysis, 100 μL of the acetonitrile quench from the selected hits from primary analysis were taken in an Eppendorf tube, and the solvent was evaporated in a speed-vac for 30 to 60 min. The resulting residue was reconstituted in 100 μL isopropanol containing 0.5% diethylamine (DEA) and the samples analyzed using normal phase HPLC method, as described in Example 8.

Hit variants were grown in 250-mL shake flask and shake flask powders generated. The activity of the SFP was evaluated at 0.9-7.5 g/L SF Powder, 30 g/L ketone substrate, 0.26 g/L PLP, 1M IPM, 20% (v/v) DMSO, 100 mM carbonate buffer, pH 10.0. The reactions were set up using a similar procedure, as described above.

TABLE 5.1

Activity of Variants Relative to SEQ ID NO: 4

| SEQ ID NO: (nt/aa) | Amino Acid Differences (Relative to SEQ ID NO: 4) | Percent Conversion Fold Improvement Relative to SEQ ID NO: 4 |
|---|---|---|
| 5/6 | G227A | +++ |
| 7/8 | L417V | ++ |
| 9/10 | G227C | ++ |
| 11/12 | L417I | ++ |
| 13/14 | L88K | + |

TABLE 5.1-continued

| Activity of Variants Relative to SEQ ID NO: 4 | | |
|---|---|---|
| SEQ ID NO: (nt/aa) | Amino Acid Differences (Relative to SEQ ID NO: 4) | Percent Conversion Fold Improvement Relative to SEQ ID NO: 4 |
| 15/16 | S97A/R415S | + |
| 17/18 | Q148G | + |
| 19/20 | L88R/M89L | + |
| 21/22 | R355C/R415S/Q419D | + |
| 23/24 | T13A | + |
| 25/26 | K443M | + |
| 27/28 | T13S | + |
| 29/30 | T13E | + |
| 31/32 | I41V/F57Y/F130Y/R415F/Q419D | + |
| 33/34 | L88V | + |
| 35/36 | T13K | + |
| 37/38 | K443E | + |
| 39/40 | L88R | + |
| 41/42 | I41V/V113F/R415F | + |
| 43/44 | Q148E | + |
| 45/46 | L417A | + |
| 47/48 | N53M/F57W | + |
| 49/50 | H362G | + |
| 51/52 | T13G | + |
| 53/54 | E302N | + |
| 55/56 | C260T | + |

[1] Levels of increased activity were determined relative to the reference polypeptide of SEQ ID NO: 4 and defined as follows: "+" 1.20 to 1.75, "++" > 1.75, "+++" > 2.50

Example 6: Improved Transaminase Activity Over SEQ ID NO: 6 in the Production of Compound (3)

SEQ ID NO: 6 was selected as the parent enzyme for the next round of evolution. Activity relative to SEQ ID NO: 6 (FIOP conversion) was calculated as the percent conversion of the product formed by the variant over the percent conversion produced by SEQ ID NO: 6 and shown in Table 6.1. The percent conversion was calculated by dividing the area of the product peak by the sum of the areas of the substrate and product peaks as observed by the HPLC-UV analysis (Example 7), and the enantioselectivity was confirmed using normal phase HPLC-UV analysis (Example 8).

The engineered polynucleotide (SEQ ID NO: 5) encoding the polypeptide with transaminase activity of SEQ ID NO: 6 was used to generate the engineered polypeptides of Table 6.1 These polypeptides displayed improved transaminase activity under the desired conditions (e.g., ketone substrate, compound (2), 1-imidazo[1,2-a]pyridin-6-ylethanone to product, compound (3), (1S)-1-imidazo[1,2-a]pyridin-6-ylethanamine) as compared to the starting polypeptide. The engineered polypeptides, having the amino acid sequences of even-numbered sequence identifiers were generated from the "backbone" amino acid sequence of SEQ ID NO: 6 as described, and identified using the HTP assay, described below, and analytical methods shown in Table 7.1.

Directed evolution began with the polynucleotide set forth in SEQ ID NO: 5. Libraries of engineered polypeptides were generated using various well-known techniques (e.g., saturation mutagenesis, recombination of previously identified beneficial amino acid differences) and screened using the HTP assay below and the analytical method described in Table 7.1.

The enzyme assay was carried out in a 96-well deep-well (2 mL) plates, in 100 μL total volume/well. The reactions were carried out using 20 μL of 10× diluted HTP lysate, 35 g/L ketone substrate, 0.24 g/L PLP, 1M IPM, 20% (v/v) DMSO, 100 mM borate buffer, pH 10.0. The reactions were set up by adding the following: 1.) 20 μL of 175 g/L substrate ketone in DMSO 2.) 60 μL of a master mix solution containing 1.65 M IPM, pH 10.0, 170 mM borate buffer, pH 10.0 and 0.4 g/L PLP, 3) 20 μL of HTP lysate. The reaction plate was heat-sealed at 180° C. for 2s. The plates were then shaken at 600 rpm at 50° C. for 20 hours.

After the 20-hour incubation, 300 μL of acetonitrile were added into each well, and the plates were re-sealed and shaken for 10 minutes at room temperature followed by centrifuging at 4° C. for 10 min. In a new plate, 20 μL of the samples from the above plate were further diluted by adding 180 μL of 1:1 mixture of water:acetonitrile. The plates were sealed and mixed at room temperature for 2 min prior to achiral HPLC analysis as described in Example 7.

For chiral analysis, 100 μL of the acetonitrile quench from the selected hits from primary analysis were taken in an Eppendorf tube, and the solvent was evaporated in a speed-vac for 30 to 60 min. The resulting residue was reconstituted in 100 μL isopropanol containing 0.5% diethylamine (DEA) and the samples analyzed using normal phase HPLC method as described in Example 8

Hit variants were grown in 250-mL shake flask and shake flask powders generated. The activity of the SFP was evaluated at 0.9-7.5 g/L SF Powder, 35 g/L ketone substrate, 0.26 g/L PLP, 1M IPM, 20% (v/v) DMSO, 100 mM borate buffer, pH 10.0. The reactions were set up using a similar procedure as described above.

TABLE 6.1

| Activity of Variants Relative to SEQ ID NO: 6 | | |
|---|---|---|
| SEQ ID NO: (nt/aa) | Amino Acid Differences (Relative to SEQ ID NO: 6) | Percent Conversion Fold Improvement Relative to SEQ ID NO: 6 |
| 57/58 | T13E/L417V/K443M | +++ |
| 59/60 | I41V/L417V/K443M | +++ |
| 61/62 | R415S/L417V | +++ |
| 63/64 | T13E/I41V/L88R/F130Y/R415S/K443M | +++ |
| 65/66 | I41V/F130Y/R415S/L417I/K443M | +++ |
| 67/68 | T13E/F130Y/L417V | ++ |
| 69/70 | T13E/I41V/S97A/L417I/K443M | ++ |
| 71/72 | T13A/L417I/K443M | ++ |
| 73/74 | T13E/M89L/S97A/L417V | ++ |
| 75/76 | T13A/I41V/F57Y/F130Y/L417V | ++ |
| 77/78 | L88R/R415S | ++ |
| 79/80 | T13E/L417V | ++ |
| 81/82 | T13A/I41V/L417V/K443M | ++ |
| 83/84 | F130Y/K443M | ++ |
| 85/86 | T13A/I41V/S97A/L417I | ++ |
| 87/88 | T13E/F130Y/L417I/K443M | ++ |
| 89/90 | L88R/R415S/L417I | ++ |
| 91/92 | I41V/R415S/K443M | ++ |
| 93/94 | I41V/L88R/M89L/S97A/F130Y/R415S | ++ |
| 95/96 | I41V/L88R/M89L/R415S/L417I | ++ |
| 97/98 | T13A/M89L/L417I | ++ |
| 99/100 | T13E/I41V/S97A/R415S/L417V | ++ |
| 101/102 | T13A/S97A/L417V | ++ |
| 103/104 | T13E/L88R/M89L/R415S/L417V/K443M | ++ |
| 105/106 | R415S | ++ |
| 107/108 | T13E/I41V/L88R | ++ |
| 109/110 | T13A/F57Y/L88R/F130Y/R415S | ++ |
| 111/112 | T13E/I41V/S97A/F130Y/L417I | ++ |
| 113/114 | R415A/L417V/G418D/A432V | ++ |
| 115/116 | T13A/L88R/M89L/R415S/L417V | ++ |
| 117/118 | L88R/F130Y/L417I/K443M | ++ |
| 119/120 | F130Y/L417I | + |
| 121/122 | L88R/R415S/L417I/K443M | + |
| 123/124 | T13A/F57Y/L88R/F130Y/L417V/K443M | + |
| 125/126 | I41V/S97A/F130Y/Q148G/R415S/L417V/K443M | + |
| 127/128 | I41V/L88R/S97A/F130Y/L417I | + |
| 129/130 | R415A/L417V/G418D | + |

TABLE 6.1-continued

Activity of Variants Relative to SEQ ID NO: 6

| SEQ ID NO: (nt/aa) | Amino Acid Differences (Relative to SEQ ID NO: 6) | Percent Conversion Fold Improvement Relative to SEQ ID NO: 6 |
|---|---|---|
| 131/132 | T13A/F130Y/L417V | + |
| 133/134 | L88R/L417I | + |
| 135/136 | I41V/L417I | + |
| 137/138 | I41V/L88R/F130Y/R415S/L417I | + |
| 139/140 | T13A/I41V/M89L/K443M | + |
| 141/142 | L88R/R415S/L417V/K443M | + |
| 143/144 | L88R/M89L/F130Y/L417I | + |
| 145/146 | I41V/S97A/L417I/K443M | + |
| 147/148 | T13A/F57Y/L88R/S97A/R415S/K443M | + |
| 149/150 | S97A/F130Y | + |
| 151/152 | T13E/L88R/M89L/R415S/L417I | + |
| 153/154 | P23K/T277I/G395D/L417V/G418D | + |
| 155/156 | T13E/I41V/L88R/M89L/L417V | + |
| 157/158 | T13A/R415S/L417V | + |
| 159/160 | S97A | + |
| 161/162 | N53C/G162A/G395D/L417V | + |
| 163/164 | T13E/L88R/M89L/R415S/L417V | + |
| 165/166 | L88R/S97A/R415S/L417I/K443M | + |
| 167/168 | G162A/G395D/R415A/L417V | + |
| 169/170 | F57Y/L88R/S97A/F130Y/L417V | + |
| 171/172 | T233I/E315G/L417V | + |
| 173/174 | T13E/I41V/L417V | + |
| 175/176 | T13E/F57Y/L88R/S97A/R415S/K443M | + |
| 177/178 | L88R/Q148G/L417V/K443M | + |
| 179/180 | T13A/L88R/R415S | + |
| 181/182 | T13A/I41V/F130Y/R415S/K443M | + |
| 183/184 | R415S/L417V/K443M | + |
| 185/186 | P23K/N53C/E315G/L417V/G418D | + |
| 187/188 | T13A/F57Y/L88R/S97A | + |
| 189/190 | G162A/T233I/R415A/L417V | + |
| 191/192 | T13E/I41V/M89L/L417V | + |
| 193/194 | I41V/S97A/L417I | + |
| 195/196 | N53C/T277I/G395D/L417V/G418D | + |
| 197/198 | I41V | + |
| 199/200 | T233I/E315G/R415A/L417V | + |
| 201/202 | T13A/L88R/F130Y/K443M | + |
| 203/204 | F57Y/L417V | + |
| 205/206 | T13A/F57Y/L88R/M89L/F130Y/R415S/K443M | + |
| 207/208 | T13A/I41V/F57Y/M89L/S97A/L417V | + |
| 209/210 | S97A/R415S | + |
| 211/212 | T13E/M89L/S97A/R415S/L417V | + |
| 213/214 | I41V/L417V | + |
| 215/216 | T277I/G395D/R415A/G418D/A432V | + |
| 217/218 | S97A/R415S/L417V | + |
| 219/220 | T13E/L417I | + |
| 221/222 | I41V/F57Y/R415S/L417I | + |
| 223/224 | F57Y/S97A/F130Y/Q148G/L417I/K443M | + |
| 225/226 | T13A/I41V/F57Y/L88R/F130Y/R415S/L417V | + |
| 227/228 | R415S/L417I/K443M | + |
| 229/230 | T13A/I41V/F57Y/L417I | + |
| 231/232 | T13E/I41V/L88R/M89L/S97A/R415S/K443M | + |
| 233/234 | T13A/I41V/R415S/L417V | + |
| 235/236 | T13A/R415S/K443M | + |
| 237/238 | T13A/R415S/L417I/K443M | + |
| 239/240 | T13A/I41V/F57Y/S97A/F130Y/R415S/L417I/K443M | + |
| 241/242 | E315G/R415A/G418D/A432V | + |
| 243/244 | K443M | + |
| 245/246 | I41V/F57Y/F130Y/K443M | + |
| 247/248 | M89L/S97A/L417I | + |
| 249/250 | T13E/K443M | + |
| 251/252 | N53C/T277I/R415A/L417G | + |
| 253/254 | T13E/I41V/R415S/K443M | + |
| 255/256 | T13A/S97A/L417I | + |
| 257/258 | L417V | + |
| 259/260 | T13E/S97A/R415S/L417V | + |
| 261/262 | T13A/I41V/R415S/L417I | + |
| 263/264 | T13E/I41V/S97A/R415S | + |
| 265/266 | T13E/I41V/L88R/S97A | + |
| 267/268 | P23K/G418D | + |
| 269/270 | G395D/G418D | + |
| 271/272 | F57Y/L88R/S97A/L417I | + |
| 273/274 | I41V/F130Y/R415S | + |
| 275/276 | F57Y/L88R/S97A/F130Y/R415S/K443M | + |
| 277/278 | P23K/G395D/G418D | + |
| 279/280 | R415A/L417V | + |
| 281/282 | T13E/F130Y/R415S | + |
| 283/284 | M89L/K443M | + |
| 285/286 | T13A/S97A/Q148G/R415S | + |
| 287/288 | I41V/F57Y/L88R | + |
| 289/290 | T13E/R415S/K443M | + |
| 291/292 | T13A/I41V/L88R/K443M | + |
| 293/294 | I41V/F130Y/R415S/K443M | + |
| 295/296 | T13A/I41V/M89L/F130Y/Q148G/K443M | + |
| 297/298 | T13A/I41V/L88R/M89L | + |
| 299/300 | M89L/S97A/R415S/L417I | + |
| 301/302 | T13E/I41V/F57Y/S97A/F130Y/R415S/L417V | + |
| 303/304 | P23K/N53C/G162A/T233I/T277I/E315G/R415A/G418D/A432V | + |
| 305/306 | T13A/F57Y/L88R/R415S | + |
| 307/308 | S97A/R415S/L417I | + |
| 309/310 | T13E/F57Y/S97A/F130Y/R415S/L417V/K443M | + |
| 311/312 | T13E/F130Y/R415S/L417I | + |
| 313/314 | I41V/F57Y/L88R/R415S/K443M | + |
| 315/316 | N53C/G162A | + |
| 317/318 | S97A/L417I | + |
| 319/320 | R415S/K443M | + |
| 321/322 | S97A/Q148G/R415S | + |
| 323/324 | L88R | + |
| 325/326 | E315G | + |
| 327/328 | T13E/F57Y/S97A/L417V | + |
| 329/330 | T13E/S97A/R415S | + |
| 331/332 | F130Y/R415S | + |
| 333/334 | P23K/T277I/E315G/G395D/R415A/L417G/A432V | + |
| 335/336 | F130Y | + |
| 337/338 | I41V/F57Y/F130Y/Q148G/R415S/L417I | + |
| 339/340 | T13A/R415S | + |
| 341/342 | T13A | + |
| 343/344 | I41V/L88R/K443M | + |
| 345/346 | T13A/I41V/R415S | + |
| 347/348 | R415A/L417G/G418D | + |
| 349/350 | N53C/G162A/G418D/A432V | + |
| 351/352 | N53C/T277I/G395D | + |
| 353/354 | G162A/G418D | + |
| 355/356 | N53C/T233I | + |
| 357/358 | T13E/I41V/F57Y/S97A/K443M | + |

[1] Levels of increased activity were determined relative to the reference polypeptide of SEQ ID NO: 6 and defined as follows: "+" 1.20 to 1.90, "++" > 1.90, "+++" > 2.5

Example 7: Analytical Detection of Product 1-imidazo[1,2-a]pyridin-6-ylethanamine by HPLC-UV Data described in Examples 5 and 6 were collected using the analytical method provided in Table 7.1. The method provided herein finds use in analyzing the variants produced using the present invention. However, it is not intended that present invention be limited to the methods described herein, as there are other suitable methods known in the art that are applicable to the analysis of the variants provided herein and/or produced using the methods provided herein.

TABLE 7.1

| Achiral HPLC Method Parameters | | |
|---|---|---|
| Instrument | Agilent 1260 pump HPLC instrument | |
| Column | Agilent poroshell C18 column 150 mm × 4.6 mm × 5 u | |
| Mobile Phase | Gradient (A: 0.1% TFA in water; B: 0.1% TFA in acetonitrile | |
| | Time(min) | % B |
| | 0.00 | 5 |
| | 1.40 | 25 |
| | 1.50 | 5 |
| | 2.00 | 5 |
| Flow Rate | 2 mL/min | |
| Run time | 2.0 min | |
| Peak Retention Times | Mix of compound (3), (lS)-l-imidazo[l,2-a]pyridin-6-ylethanamine and (lR)-l-imidazo[l,2-a]pyridin-6-ylethanamine - 0.97 min; unknown - 1.12 min; compound (2), l-imidazo[l,2-a]pyridin-6-ylethanone - 1.7 min | |
| Column Temperature | 45° C. | |
| Injection Volume | 2 μL | |
| UV Detection | 280 nm | |

Example 8: Analytical Detection of (1S)-1-imidazo[1,2-a]pyridin-6-ylethanamine by Normal Phase HPLC-UV Data described in Examples 5 and 6 were collected using the analytical method provided in Table 7.1 and the chiral identity of the hit variants verified using the analytical method provided here in Table 8.1. The method provided herein finds use in separating and identifying the product isomers produced using the present invention. However, it is not intended that present invention be limited to the methods described herein, as there are other suitable methods known in the art that are applicable to the analysis of the variants provided herein and/or produced using the methods provided herein.

TABLE 8.1

| Chiral HPLC Method Parameters | |
|---|---|
| Instrument | Agilent 1260 pump HPLC instrument |
| Column | Chiralpak AS-H column 250 mm × 4.6 mm × 5 u |
| Mobile Phase | 60:40 heptane:isopropanol with 0.2% diethyl amine (DEA) Isocratic elution |
| Flow Rate | 0.8 mL/min |
| Run time | 14.0 min |
| Peak Retention Times | (lR)-l-imidazo[l,2-a]pyridin-6-ylethanamine isomer - 9.4 min; (lS)-l-imidazo[l,2-a]pyridin-6-ylethanamine isomer - 10.4 min |
| Column Temperature | 40° C. |
| Injection Volume | 10 μL |
| UV Detection | 280 nm |

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (358 sequences)

SEQ ID NO: 1 - DNA, 1362 bp, Artificial Sequence
  Wild Type Transaminase enzyme from Vibrio fluvialis
atgaacaaaccgcagagctgggaaacgcgtgcggaaacctatagcctgtatggctttaccgatatgccgagcctgcatcagcgtggcaccgtggtggtgacccatggcgaaggcccgtatatcgtggatgtgcatggccgtcgttatctggatgcgaacagcggcctgtggaacatggtggcgggctttgatcataaaggcctgattgatgcggcgaaagcgcagtatgaacgttttccgggctatcatgcgttttacggccgtatgagcgatcagaccgtgatgctgtctgaaaaactggtggaagtgagcccgtttgatagcggccgtgtgttttataccaacagcggcagcgaagcgaacgataccatggtgaaaatgctgtggtttctgcatgcggcggaaggcaaaccgcagaaacgtaaaattctgacccgttggaacgcgtatcatggcgtgaccgcggtgagcgcgagcatgaccggcaaaccgtataacagcgtgtttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattccgccggcgaaaggctattttcaggcgattctgccgatcctgcgcaaatatgatattccggtgatcagcgatgaagtgatttgcggctttggccgtaccggcaacacctggggctgcgtgacctatgattttaccccggatgcgattattagcagtaaaaacctaaccgcgggtttttttccggtaggcgcggtgattctgggtccggaactgagcaaacgtctggaaaccgcgattgaagcgatcgaagaatttccgcatggttttaccgcgggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggcattggctttatgtgggcgctggaagcggtgaaagataaagcgagcaaagccccgtttgatggcaacctgagcgtgagcgaacgtattgcgaacacctgcaccgatctgggcctgatttgccgtccgctgggccagagcgtggttctgtgcccgccgtttattctgaccgaagcgcagatggatgaaatgttcgataaactggaaaaagcgctggataaagtgtttgcggaagtggcgtaa

SEQ ID NO: 2 - protein, 453 aa, Artificial Sequence
  Wild Type Transaminase enzyme from Vibrio fluvialis
MNKPQSWETRAETYSLYGFTDMPSLHQRGTVVVTHGEGPYIVDVHGRRYLDANSGLWNMVAGFDHKGLIDAAKAQYERFPGYHAFYGRMSDQTVMLSEKLVEVSPFDSGRVFYTNSGSEANDTMVKMLWFLHAAEGKPQKRKILTRWNAYHGVTAVSASMTGKPYNSVFGLPLPGFLHLTCPHYWRYGEEGETEEQFVARLARELEETIQKEGADTIAGFFAEPVMGAGGVIPPAKGYFQAILPILRKYDIPVISDEVICGFGRTGNTWGCVTYDFTPDAIISSKNLTAGFFPVGAVILGPELSKRLETAIEAIEEFPHGFTAGGHPVGCAIALKAIDVVMNEGLAENVRRLAPRFEERLKHIAERPNIGEYRGIGFMWALEAVKDKASKAPFDGNLSVSERIANTCTDLGLICRPLGQSVVLCPPFILTEAQMDEMFDKLEKALDKVFAEVA

SEQ ID NO: 3 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 4 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 5 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 6 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 7 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccggtgggccagagcgtggttctggcaccgccgtacattctgaccgaagcgcagatggatgaaatgttcgataaactggaaaaagcgctggataaagtgtttgcggaagtggcgtaa

SEQ ID NO: 8 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 9 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgtgtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 10 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMCAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 11 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgattggccagagcgtggttctggcaccgccgtacattctgaccgaagcgcagatggatgaaatgttcgataaactggaaaaagcgctggataaagtgtttgcggaagtggcgtaa

SEQ ID NO: 12 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 13 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcaagatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 14 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGKMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 15 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagctcgaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgttgggccaaagcgtggttctggccccgccgtacattctgaccgaagcgcagatggatgaaatgttcgataaactggaaaaagcgctggataaagtgtttgcggaagtggcgtaa

SEQ ID NO: 16 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 17 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagggtgcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 18 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKGAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 19 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggccgcctgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 20 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 21 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgtgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgttgggcgacagcgtggttctggccccgccgtacattctgaccgaagcgcagatggatgaaatgttcgataaactggaaaaagcgctggataaagtgtttgcggaagtggcgtaa

SEQ ID NO: 22 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPCFEERLKHIAERPNIGEYRGVGFMWALEVVKDKASKAPFDGNLSVSERIANTCTDLGLICSPLGDSVVLAPPYILTEAQMDEMFDKLEKALDKVFAEVA

SEQ ID NO: 23 - DNA, 1362 bp, Artificial Sequence
  Variant of Transaminase enzyme from Vibrio fluvialis
atgaacaaaccgcagagctgggaaacgcgtgcggaagctgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 24 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 25 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaatggcgctggataaagtgtttgcggaagtggcgtaa

SEQ ID NO: 26 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

SEQ ID NO: 27 - DNA, 1362 bp, Artificial Sequence
  Variant of Transaminase enzyme from Vibrio fluvialis
atgaacaaaccgcagagctgggaaacgcgtgcggaaagtgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 28 - protein, 453 aa, Artificial Sequence
  Variant of Transaminase enzyme from Vibrio fluvialis
MNKPQSWETRAESVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 29 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 30 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 31 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatgttgtggatgtgcatggccgtcgttatctggatgcgaacagcggcctgtacaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtatctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatctcggatgaagtgatttgcggctttggtcgtaccggcaacacctggggctgcgtgacctatgattttaccccggatgcgattattagctcgaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgctttccgttgggcgacagcgtggttctggccccgccgtacattctgaccgaagcgcagatggatgaaatgttcgataaactggaaaaagcgctggataaagtgtttgcggaagtggcgtaa

SEQ ID NO: 32 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLYNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICFPLGDSVVLAPPYILTEAQMDEMFDKLEKALDKVFAEVA

SEQ ID NO: 33 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcgttatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 34 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGVMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 35 - DNA, 1362 bp, Artificial Sequence
  Variant of Transaminase enzyme from Vibrio fluvialis
atgaacaaaccgcagagctgggaaacgcgtgcggaaaaggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 36 - protein, 453 aa, Artificial Sequence
  Variant of Transaminase enzyme from Vibrio fluvialis
MNKPQSWETRAEKVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 37 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaagaggcgctggataaagtgtttgcggaagtggcgtaa

SEQ ID NO: 38 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEEALDKVFAEVA

SEQ ID NO: 39 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggccgcatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 40 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 41 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatgttgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttttcaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatctcggatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgctttccgttgggccaaagcgtggttctggccccgccgtacattctgaccgaagcgcagatggatgaaatgttcgataaactggaaaaagcgctggataaagtgtttgcggaagtggcgtaa

SEQ ID NO: 42 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFFTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICFPLGQSVVLAPPYILTEAQMDEMFDKLEKALDKVFAEVA

SEQ ID NO: 43 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaaggaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 44 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKEAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 45 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccggcgggccagagcgtggttctggcaccgccgtacattctgaccgaagcgcagatggatgaaatgttcgataaactggaaaaagcgctggataaagtgtttgcggaagtggcgtaa

SEQ ID NO: 46 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPAGQSVVLAPPYILTEAQMDEMFDKLEKALDKVFAEVA

SEQ ID NO: 47 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgatgagcggcctgtggaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 48 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDAMSGLWNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 49 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaaggtattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 50 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKGIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 51 - DNA, 1362 bp, Artificial Sequence
  Variant of Transaminase enzyme from Vibrio fluvialis
atgaacaaaccgcagagctgggaaacgcgtgcggaaggggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 52 - protein, 453 aa, Artificial Sequence
  Variant of Transaminase enzyme from Vibrio fluvialis
MNKPQSWETRAEGVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 53 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccgaatctgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 54 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVICGFGRTGNTWGCVTYDFTPDAIISSKNLTAGFFPVGAVILGPNLSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 55 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatgggtgcgggcggtgttattaccccgccaaaaggctattttcaggcgattctgaccatcctgcgcaaatatgatattccggtgatcagcgatgaagtgattacgggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 56 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMGAGGVITPPKGYFQAILTILRKYDIPVISDEVITGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 57 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaatggcgctggataaagtgtttgcggaagtggcgtaa

SEQ ID NO: 58 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEMALDKVFAEVA

SEQ ID NO: 59 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaatggcgctggataaagtgtttgcggaagtggcgtaa

SEQ ID NO: 60 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEMALDKVFAEVA

SEQ ID NO: 61 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaaaagcgctggataaagtgtttgcggaagtggcgtaa

SEQ ID NO: 62 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEKALDKVFAEVA

SEQ ID NO: 63 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 64 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGRMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 65 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaatggcgctggataaagtgtttgcggaagtggcgtaa

SEQ ID NO: 66 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEMALDKVFAEVA

SEQ ID NO: 67 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaggcgctggataaagtgtttgcggaagtggcgtaa

SEQ ID NO: 68 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 69 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttcttgcaccgccgtacattctgaccgaagcgcagatggatgaaatgttcgataaactggaaatggcgctggataaagtgtttgcggaagtggcgtaa

SEQ ID NO: 70 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEMALDKVFAEVA

SEQ ID NO: 71 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaatggcgctggataaagtgtttgcggaagtggcgtaa

SEQ ID NO: 72 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEMALDKVFAEVA

SEQ ID NO: 73 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgctgagcgatcagaccgtgatgctggcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaggcgctggataaagtgtttgcggaagtggcgtaa

SEQ ID NO: 74 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLLSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 75 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaggcgctggataaagtgtttgcggaagtggcgtaa

SEQ ID NO: 76 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLYNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 77 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 78 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 79 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaggcgctggataaagtgtttgcggaagtggcgtaa

SEQ ID NO: 80 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 81 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaatggcgctggataaagtgtttgcggaagtggcgtaa

SEQ ID NO: 82 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEMALDKVFAEVA

SEQ ID NO: 83 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaatggcgctggataaagtgtttgcggaagtggcgtaa

SEQ ID NO: 84 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

SEQ ID NO: 85 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaggcgctggataaagtgtttgcggaagtggcgtaa

SEQ ID NO: 86 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 87 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaatggcgctggataaagtgtttgcggaagtggcgtaa

SEQ ID NO: 88 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEMALDKVFAEVA

SEQ ID NO: 89 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggccgtatgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaaaggcgctggataaagtgtttgcggaagtggcgtaa

SEQ ID NO: 90 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEKALDKVFAEVA

SEQ ID NO: 91 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 92 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 93 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtctgagcgatcagaccgtgatgctggcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 94 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGRLSDQTVMLAEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 95 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtctgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaaaggcgctggataaagtgtttgcggaagtggcgtaa

SEQ ID NO: 96 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGRLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEKALDKVFAEVA

SEQ ID NO: 97 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgctgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaagcgctggataaagtgtttgcggaagtggcgtaa

SEQ ID NO: 98 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 99 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaaaagcgctggataaagtgtttgcggaagtggcgtaa

SEQ ID NO: 100 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEKALDKVFAEVA

SEQ ID NO: 101 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaggcgctggataaagtgtttgcggaagtggcgtaa

SEQ ID NO: 102 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 103 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtctgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaatggcgctggataaagtgtttgcggaagtggcgtaa

SEQ ID NO: 104 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGRLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEMALDKVFAEVA

SEQ ID NO: 105 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 106 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 107 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggccgtatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaaaggcgctggataaagtgtttgcggaagtggcgtaa

SEQ ID NO: 108 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 109 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctgtctgaaaaactggtggaagtgagcccgtttgatagcggccgtgtgtttgtaaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 110 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLYNMVAGFDHKGLIDAAKAQYERFPGYHAFYGRMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 111 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaagcgctggataaagtgtttgcggaagtggcgtaa

SEQ ID NO: 112 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGLMSDQTVMLAEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 113 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttactccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgcgcgccggtcgatcagagcgtggttctggcaccgccgtacattctgaccgaagtacagatggatgaaatgttcgataaactggaaaaagcgctggataaagtgtttgcggaagtggcgtaa

SEQ ID NO: 114 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICAPVDQSVVLAPPYILTEVQMDEMFDKLEKALDKVFAEVA

SEQ ID NO: 115 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggccgtctgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaaaagcgctggataaagtgtttgcggaagtggcgtaa

SEQ ID NO: 116 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGRLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEKALDKVFAEVA

SEQ ID NO: 117 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaatggcgctggataaagtgtttgcggaagtggcgtaa

SEQ ID NO: 118 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEMALDKVFAEVA

SEQ ID NO: 119 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaggcgctggataaagtgtttgcggaagtggcgtaa

SEQ ID NO: 120 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 121 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaatggcgctggataaagtgtttgcggaagtggcgtaa

SEQ ID NO: 122 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEMALDKVFAEVA

SEQ ID NO: 123 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaatggcgctggataaagtgtttgcggaagtggcgtaa

SEQ ID NO: 124 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLYNMVAGFDHKGLIDAAKAQYERFPGYHAFYGRMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEMALDKVFAEVA

SEQ ID NO: 125 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagggggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaatggcgctggataaagtgtttgcggaagtggcgtaa

SEQ ID NO: 126 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLAEKLVEVSPFDSGRVFVTNSGSEANETMVKMLWYLHRAEGKPQKRKILTLKGAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEMALDKVFAEVA

SEQ ID NO: 127 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctggcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaggcgctggataaagtgtttgcggaagtggcgtaa

SEQ ID NO: 128 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGRMSDQTVMLAEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 129 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttactccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgcgcgccggtcgatcagagcgtggttctggcaccgccgtacattctgaccgaagcgcagatggatgaaatgttcgataaactggaaaaagcgctggataaagtgtttgcggaagtggcgtaa

SEQ ID NO: 130 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICAPVDQSVVLAPPYILTEAQMDEMFDKLEKALDKVFAEVA

SEQ ID NO: 131 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaagcgctggataaagtgtttgcggaagtggcgtaa

SEQ ID NO: 132 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 133 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaagcgctggataaagtgtttgcggaagtggcgtaa

SEQ ID NO: 134 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 135 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatgtcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaagcgctggataaagtgtttgcggaagtggcgtaa

SEQ ID NO: 136 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 137 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaaaagcgctggataaagtgtttgcggaagtggcgtaa

SEQ ID NO: 138 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGRMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEKALDKVFAEVA

SEQ ID NO: 139 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgctgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaatggcgctggataaagtgtttgcggaagtggcgtaa

SEQ ID NO: 140 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLFNMVAGFDHKGLIDAAKAQYERFPGYHAFYGLLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

SEQ ID NO: 141 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaatggcgctggataaagtgtttgcggaagtggcgtaa

SEQ ID NO: 142 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEMALDKVFAEVA

SEQ ID NO: 143 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtctgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaagcgctggataaagtgtttgcggaagtggcgtaa

SEQ ID NO: 144 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRLSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 145 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaatggcgctggataaagtgtttgcggaagtggcgtaa

SEQ ID NO: 146 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEMALDKVFAEVA

SEQ ID NO: 147 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 148 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLYNMVAGFDHKGLIDAAKAQYERFPGYHAFYGRMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 149 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaaaggcgctggataaagtgtttgcggaagtggcgtaa

SEQ ID NO: 150 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 151 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtctgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaaaggcgctggataaagtgtttgcggaagtggcgtaa

SEQ ID NO: 152 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGRLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEKALDKVFAEVA

SEQ ID NO: 153 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgaagagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgggctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttattccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatgataacctgagcgtgagcgaacgtattgcgaacacctgcaccgatctgggactgatttgccgtccggtcgatcagagcgtggttctggcaccgccgtacattctgaccgaagcgcagatggatgaaatgttcgataaactggaaaaagcgctggataaagtgtttgcggaagtggcgtaa

SEQ ID NO: 154 - protein, 453 aa, Artificial Sequence
  Variant of Transaminase enzyme from Vibrio fluvialis
MNKPQSWETRAETVSLYAFTHMKSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFIPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDDNLSVSERIANTCTDLGLICRPVDQSVVLAPPYILTEAQMDEMFDKLEKALDKVFAEVA

SEQ ID NO: 155 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtctgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaggcgctggataaagtgtttgcggaagtggcgtaa

SEQ ID NO: 156 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGRLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 157 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaaaggcgctggataaagtgtttgcggaagtggcgtaa

SEQ ID NO: 158 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEKALDKVFAEVA

SEQ ID NO: 159 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaaaggcgctggataaagtgtttgcggaagtggcgtaa

SEQ ID NO: 160 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 161 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgtgtagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgcgctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttactccggatgcgattattagcagtaaaaacctaaccgcgggtttttttccagtaggagcggtgattttggggccggaactgagcaaacgtctggaaaccgcgattgaagcgatcgaggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatgataacctgagcgtgagcgaacgtattgcgaacacctgcaccgatctgggactgatttgccgtccggtcggtcagagcgtggttctggcaccgccgtacattctgaccgaagcacagatggatgaaatgttcgataaactggaaaaagcgctggataaagtgtttgcggaagtggcgtaa

SEQ ID NO: 162 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDACSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTALGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDDNLSVSERIANTCTDLGLICRPVGQSVVLAPPYILTEAQMDEMFDKLEKALDKVFAEVA

SEQ ID NO: 163 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggccgtctgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaaaggcgctggataaagtgtttgcggaagtggcgtaa

SEQ ID NO: 164 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGRLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEKALDKVFAEVA

SEQ ID NO: 165 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaatggcgctggataaagtgtttgcggaagtggcgtaa

SEQ ID NO: 166 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEMALDKVFAEVA

SEQ ID NO: 167 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgcgctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttactccggatgcgattattagcagtaaaaacctaaccgcgggtttttttccagtaggagcggtgattttggggccggaactgagcaaacgtctggaaaccgcgattgaagcgatcgaggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatgataacctgagcgtgagcgaacgtattgcgaacacctgcaccgatctgggactgatttgcgcgccggtcggtcagagcgtggttctggcaccgccgtacattctgaccgaagcgcagatggatgaaatgttcgataaactggaaaaagcgctggataaagtgtttgcggaagtggcgtaa

SEQ ID NO: 168 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTALGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDDNLSVSERIANTCTDLGLICAPVGQSVVLAPPYILTEAQMDEMFDKLEKALDKVFAEVA

SEQ ID NO: 169 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctggcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaagcgctggataaagtgtttgcggaagtggcgtaa

SEQ ID NO: 170 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLYNMVAGFDHKGLIDAAKAQYERFPGYHAFYGRMSDQTVMLAEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 171 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattatcccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcggggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgccgtccggtcggtcagagcgtggttctggcaccgccgtacattctgaccgaagcacagatggatgaaatgttcgataaactggaaaaagcgctggataaagtgtttgcggaagtggcgtaa

SEQ ID NO: 172 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVIIPPKGYFQAILTILRKYDIPVISDEVICGFGRTGNTWGCVTYDFTPDAIISSKNLTAGFFPVGAVILGPELSKRLETAIEAIGEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 173 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaagcgctggataaagtgtttgcggaagtggcgtaa

SEQ ID NO: 174 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 175 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctggcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 176 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLYNMVAGFDHKGLIDAAKAQYERFPGYHAFYGRMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 177 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagggggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaatggcgctggataaagtgtttgcggaagtggcgtaa

SEQ ID NO: 178 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKGAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEMALDKVFAEVA

SEQ ID NO: 179 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaggcgctggataaagtgtttgcggaagtggcgtaa

SEQ ID NO: 180 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 181 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 182 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 183 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaatggcgctggataaagtgtttgcggaagtggcgtaa

SEQ ID NO: 184 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEMALDKVFAEVA

SEQ ID NO: 185 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgaagagcctacgtcagcgtggcaccatggtggtaacccatggcgaaggcccgtatatcgtggatgtgcatggccgtcgttatctggatgcgtgtagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgggctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcggggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgtccggtcgatcagagcgtggttctggcaccgccgtacattctgaccgaagcacagatggatgaaatgttcgataaactggaaaaagcgctggataaagtgtttgcggaagtggcgtaa

SEQ ID NO: 186 - protein, 453 aa, Artificial Sequence
  Variant of Transaminase enzyme from Vibrio fluvialis
MNKPQSWETRAETVSLYAFTHMKSLRQRGTMVVTHGEGPYIVDVHGRRYLDACSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIGEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVDQSVVLAPPYILTEAQMDEMFDKLEKALDKVFAEVA

SEQ ID NO: 187 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctggcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaaaggcgctggataaagtgtttgcggaagtggcgtaa

SEQ ID NO: 188 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLYNMVAGFDHKGLIDAAKAQYERFPGYHAFYGRMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 189 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgcgctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattatcccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgcgcgccggtcggtcagagcgtggttctggcaccgccgtacattctgaccgaagcgcagatggatgaaatgttcgataaactggaaaaagcgctggataaagtgtttgcggaagtggcgtaa

SEQ ID NO: 190 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTALGYNSKFGLPLPGFLHLTCPHYWRYGEEGETEEQFVARLARELEETIQKEGADTIAGFFAEPVMAAGGVIIPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICAPVGQSVVLAPPYILTEAQMDEMFDKLEKALDKVFAEVA

SEQ ID NO: 191 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgctgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaggcgctggataaagtgtttgcggaagtggcgtaa

SEQ ID NO: 192 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGLLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 193 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaggcgctggataaagtgtttgcggaagtggcgtaa

SEQ ID NO: 194 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 195 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgtgtagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgggctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttattccggatgcgattattagcagtaaaaacctaaccgcgggtttttttccagtaggagcggtgattttggggccggaactgagcaaacgtctggaaaccgcgattgaagcgatcgaggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatgataacctgagcgtgagcgaacgtattgcgaacacctgcaccgatctgggactgatttgccgtccggtcgatcagagcgtggttctggcaccgccgtacattctgaccgaagcacagatggatgaaatgttcgataaactggaaaaagcgctggataaagtgtttgcggaagtggcgtaa

SEQ ID NO: 196 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDACSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFIPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDDNLSVSERIANTCTDLGLICRPVDQSVVLAPPYILTEAQMDEMFDKLEKALDKVFAEVA

SEQ ID NO: 197 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaggcgctggataaagtgtttgcggaagtggcgtaa

SEQ ID NO: 198 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 199 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattatcccgccaaaaggctattttcaggcgattctgaccatcctgcgcaaatatgatattccggtgatcagcgatgaagtgatttgcggctttggtcgtaccggcaacacctggggctgcgtgacctatgattttactccggatgcgattattagcagtaaaaacctaaccgcgggtttttttccagtaggagcggtgattttggggccggaactgagcaaacgtctggaaaccgcgattgaagcgatcggggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgcgcgccggtcggtcagagcgtggttctggcaccgccgtacattctgaccgaagcgcagatggatgaaatgttcgataaactggaaaaagcgctggataaagtgtttgcggaagtggcgtaa

SEQ ID NO: 200 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVIIPPKGYFQAILTILRKYDIPVISDEVICGFGRTGNTWGCVTYDFTPDAIISSKNLTAGFFPVGAVILGPELSKRLETAIEAIGEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICAPVGQSVVLAPPYILTEAQMDEMFDKLEKALDKVFAEVA

SEQ ID NO: 201 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaatggcgctggataaagtgtttgcggaagtggcgtaa

SEQ ID NO: 202 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGRMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

SEQ ID NO: 203 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaggcgctggataaagtgtttgcggaagtggcgtaa

SEQ ID NO: 204 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLYNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 205 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtctgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 206 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLYNMVAGFDHKGLIDAAKAQYERFPGYHAFYGRLSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 207 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgctgagcgatcagaccgtgatgctggcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaggcgctggataaagtgtttgcggaagtggcgtaa

SEQ ID NO: 208 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLYNMVAGFDHKGLIDAAKAQYERFPGYHAFYGLLSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 209 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgactgaagcgcagatggatgaaatgttcgataaactggaaaaagcgctggataaagtgtttgcggaagtggcgtaa

SEQ ID NO: 210 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 211 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgctgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaaaggcgctggataaagtgtttgcggaagtggcgtaa

SEQ ID NO: 212 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLLSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEKALDKVFAEVA

SEQ ID NO: 213 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatgtcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaagcgctggataaagtgtttgcggaagtggcgtaa

SEQ ID NO: 214 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 215 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgggctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttattccggatgcgattattagcagtaaaaacctaaccgcgggtttttttccagtaggagcggtgattttggggccggaactgagcaaacgtctggaaaccgcgattgaagcgatcgaggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatgataacctgagcgtgagcgaacgtattgcgaacacctgcaccgatctgggactgatttgcgcgccgctggatcagagcgtggttctggcaccgccgtacattctgaccgaagtacagatggatgaaatgttcgataaactggaaaaagcgctggataaagtgtttgcggaagtggcgtaa

SEQ ID NO: 216 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFIPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDDNLSVSERIANTCTDLGLICAPLDQSVVLAPPYILTEVQMDEMFDKLEKALDKVFAEVA

SEQ ID NO: 217 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaaaagcgctggataaagtgtttgcggaagtggcgtaa

SEQ ID NO: 218 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEKALDKVFAEVA

SEQ ID NO: 219 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaagcgctggataaagtgtttgcggaagtggcgtaa

SEQ ID NO: 220 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 221 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaaaggcgctggataaagtgtttgcggaagtggcgtaa

SEQ ID NO: 222 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLYNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEKALDKVFAEVA

SEQ ID NO: 223 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagggggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaatggcgctggataaagtgtttgcggaagtggcgtaa

SEQ ID NO: 224 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLYNMVAGFDHKGLIDAAKAQYERFPGYHAFYGLMSDQTVMLAEKLVEVSPFDSGRVFVTNSGSEANETMVKMLWYLHRAEGKPQKRKILTLKGAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEMALDKVFAEVA

SEQ ID NO: 225 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaaaagcgctggataaagtgtttgcggaagtggcgtaa

SEQ ID NO: 226 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLYNMVAGFDHKGLIDAAKAQYERFPGYHAFYGRMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEKALDKVFAEVA

SEQ ID NO: 227 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggtctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaatggcgctggataaagtgtttgcggaagtggcgtaa

SEQ ID NO: 228 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEMALDKVFAEVA

SEQ ID NO: 229 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaggcgctggataaagtgtttgcggaagtggcgtaa

SEQ ID NO: 230 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLYNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 231 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtctgagcgatcagaccgtgatgctggcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 232 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGRLSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 233 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaaaagcgctggataaagtgtttgcggaagtggcgtaa

SEQ ID NO: 234 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEKALDKVFAEVA

SEQ ID NO: 235 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 236 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 237 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaatggcgctggataaagtgtttgcggaagtggcgtaa

SEQ ID NO: 238 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEMALDKVFAEVA

SEQ ID NO: 239 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaatggcgctggataaagtgtttgcggaagtggcgtaa

SEQ ID NO: 240 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLYNMVAGFDHKGLIDAAKAQYERFPGYHAFYGLMSDQTVMLAEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEMALDKVFAEVA

SEQ ID NO: 241 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttactccggatgcgattattagcagtaaaaacctaaccgcgggtttttttccagtaggagcggtgattttggggccggaactgagcaaacgtctggaaaccgcgattgaagcgatcggggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgcgcgccgctggatcagagcgtggttctggcaccgccgtacattctgaccgaagtacagatggatgaaatgttcgataaactggaaaaagcgctggataaagtgtttgcggaagtggcgtaa

SEQ ID NO: 242 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIGEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICAPLDQSVVLAPPYILTEVQMDEMFDKLEKALDKVFAEVA

SEQ ID NO: 243 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgcaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaatggcgctggataaagtgtttgcggaagtggcgtaa

SEQ ID NO: 244 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

SEQ ID NO: 245 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaatggcgctggataaagtgtttgcggaagtggcgtaa

SEQ ID NO: 246 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLYNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

SEQ ID NO: 247 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgctgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaagcgctggataaagtgtttgcggaagtggcgtaa

SEQ ID NO: 248 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLLSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 249 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaatggcgctggataaagtgtttgcggaagtggcgtaa

SEQ ID NO: 250 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

SEQ ID NO: 251 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgtgtagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgggctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttattccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgcgcgccgggcggtcagagcgtggttctggcaccgccgtacattctgaccgaagcacagatggatgaaatgttcgataaactggaaaaagcgctggataaagtgtttgcggaagtggcgtaa

SEQ ID NO: 252 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDACSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFIPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICAPGGQSVVLAPPYILTEAQMDEMFDKLEKALDKVFAEVA

SEQ ID NO: 253 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 254 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 255 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaagcgctggataaagtgtttgcggaagtggcgtaa

SEQ ID NO: 256 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 257 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaagcgctggataaagtgtttgcggaagtggcgtaa

SEQ ID NO: 258 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 259 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaaaagcgctggataaagtgtttgcggaagtggcgtaa

SEQ ID NO: 260 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEKALDKVFAEVA

SEQ ID NO: 261 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaaaagcgctggataaagtgtttgcggaagtggcgtaa

SEQ ID NO: 262 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEKALDKVFAEVA

SEQ ID NO: 263 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 264 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 265 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaaaggcgctggataaagtgtttgcggaagtggcgtaa

SEQ ID NO: 266 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLFNMVAGFDHKGLIDAAKAQYERFPGYHAFYGRMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 267 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgaagagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgggctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttactccggatgcgattattagcagtaaaaacctaaccgcgggtttttttccagtaggagcggtgattttggggccggaactgagcaaacgtctggaaaccgcgattgaagcgatcgaggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgccgtccgctggatcagagcgtggttctggcaccgccgtacattctgaccgaagcacagatggatgaaatgttcgataaactggaaaaagcgctggataaagtgtttgcggaagtggcgtaa

SEQ ID NO: 268 - protein, 453 aa, Artificial Sequence
  Variant of Transaminase enzyme from Vibrio fluvialis
MNKPQSWETRAETVSLYAFTHMKSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLDQSVVLAPPYILTEAQMDEMFDKLEKALDKVFAEVA

SEQ ID NO: 269 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatgataacctgagcgtgagcgaacgtattgcgaacacctgcaccgatctgggactgatttgccgtccgctggatcagagcgtggttctggcaccgccgtacattctgaccgaagcacagatggatgaaatgttcgataaactggaaaaagcgctggataaagtgtttgcggaagtggcgtaa

SEQ ID NO: 270 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDDNLSVSERIANTCTDLGLICRPLDQSVVLAPPYILTEAQMDEMFDKLEKALDKVFAEVA

SEQ ID NO: 271 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaggcgctggataaagtgtttgcggaagtggcgtaa

SEQ ID NO: 272 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLYNMVAGFDHKGLIDAAKAQYERFPGYHAFYGRMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 273 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 274 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 275 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctggcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 276 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLYNMVAGFDHKGLIDAAKAQYERFPGYHAFYGRMSDQTVMLAEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 277 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgaagagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatgataacctgagcgtgagcgaacgtattgcgaacacctgcaccgatctgggactgatttgccgtccgctggatcagagcgtggttctggcaccgccgtacattctgaccgaagcgcagatggatgaaatgttcgataaactggaaaaagcgctggataaagtgtttgcggaagtggcgtaa

SEQ ID NO: 278 - protein, 453 aa, Artificial Sequence
  Variant of Transaminase enzyme from Vibrio fluvialis
MNKPQSWETRAETVSLYAFTHMKSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDDNLSVSERIANTCTDLGLICRPLDQSVVLAPPYILTEAQMDEMFDKLEKALDKVFAEVA

SEQ ID NO: 279 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgggctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgcgcgccggtcggtcagagcgtggttctggcaccgccgtacattctgaccgaagcgcagatggatgaaatgttcgataaactggaaaaagcgctggataaagtgtttgcggaagtggcgtaa

SEQ ID NO: 280 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICAPVGQSVVLAPPYILTEAQMDEMFDKLEKALDKVFAEVA

SEQ ID NO: 281 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaggcgctggataaagtgtttgcggaagtggcgtaa

SEQ ID NO: 282 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 283 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgctgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaatggcgctggataaagtgtttgcggaagtggcgtaa

SEQ ID NO: 284 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

SEQ ID NO: 285 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagggggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 286 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKGAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 287 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaaaggcgctggataaagtgtttgcggaagtggcgtaa

SEQ ID NO: 288 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLYNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 289 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 290 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 291 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaatggcgctggataaagtgtttgcggaagtggcgtaa

SEQ ID NO: 292 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

SEQ ID NO: 293 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatgtcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 294 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 295 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgctgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagggggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaatggcgctggataaagtgtttgcggaagtggcgtaa

SEQ ID NO: 296 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLFNMVAGFDHKGLIDAAKAQYERFPGYHAFYGLLSDQTVMLSEKLVEVSPFDSGRVFVTNSGSEANETMVKMLWYLHRAEGKPQKRKILTLKGAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

SEQ ID NO: 297 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtctgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 298 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLFNMVAGFDHKGLIDAAKAQYERFPGYHAFYGRLSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 299 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgctgagcgatcagaccgtgatgctggcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaaaagcgctggataaagtgtttgcggaagtggcgtaa

SEQ ID NO: 300 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLLSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEKALDKVFAEVA

SEQ ID NO: 301 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaaaagcgctggataaagtgtttgcggaagtggcgtaa

SEQ ID NO: 302 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLYNMVAGFDHKGLIDAAKAQYERFPGYHAFYGLMSDQTVMLAEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEKALDKVFAEVA

SEQ ID NO: 303 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgaagagcctacgtcagcgtggcaccatggtggtaacccatggcgaaggcccgtatatcgtggatgtgcatggccgtcgttatctggatgcgtgtagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgcgctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattatcccgccaaaaggctattttcaggcgattctgaccatcctgcgcaaatatgatattccggtgatcagcgatgaagtgatttgcggctttggtcgtaccggcaacacctggggctgcgtgacctatgattttattccggatgcgattattagcagtaaaaacctaaccgcgggtttttttccagtaggagcggtgattttggggccggaactgagcaaacgtctggaaaccgcgattgaagcgatcggggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgcgcgccgctggatcagagcgtggttctggcaccgccgtacattctgaccgaagtacagatggatgaaatgttcgataaactggaaaaagcgctggataaagtgtttgcggaagtggcgtaa

SEQ ID NO: 304 - protein, 453 aa, Artificial Sequence
  Variant of Transaminase enzyme from Vibrio fluvialis
MNKPQSWETRAETVSLYAFTHMKSLRQRGTMVVTHGEGPYIVDVHGRRYLDACSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTALGYNSKFGLPLPGFLHLTCPHYWRYGEEGETEEQFVARLARELEETIQKEGADTIAGFFAEPVMAAGGVIIPPKGYFQAILTILRKYDIPVISDEVICGFGRTGNTWGCVTYDFIPDAIISSKNLTAGFFPVGAVILGPELSKRLETAIEAIGEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICAPLDQSVVLAPPYILTEVQMDEMFDKLEKALDKVFAEVA

SEQ ID NO: 305 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 306 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLYNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 307 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaaaagcgctggataaagtgtttgcggaagtggcgtaa

SEQ ID NO: 308 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEKALDKVFAEVA

SEQ ID NO: 309 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccggttggccagagcgtggttctggcaccgccgtacattctgaccgaagcgcagatggatgaaatgttcgataaactggaaatggcgctggataaagtgtttgcggaagtggcgtaa

SEQ ID NO: 310 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLYNMVAGFDHKGLIDAAKAQYERFPGYHAFYGLMSDQTVMLAEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPVGQSVVLAPPYILTEAQMDEMFDKLEMALDKVFAEVA

SEQ ID NO: 311 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaaaggcgctggataaagtgtttgcggaagtggcgtaa

SEQ ID NO: 312 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEKALDKVFAEVA

SEQ ID NO: 313 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 314 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLYNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 315 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgtgtagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgcgctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttactccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 316 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDACSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTALGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 317 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgattggccagagcgtggttctggcaccgccgtacattctgaccgaagcgcagatggatgaaatgttcgataaactggaaaaagcgctggataaagtgtttgcggaagtggcgtaa

SEQ ID NO: 318 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPIGQSVVLAPPYILTEAQMDEMFDKLEKALDKVFAEVA

SEQ ID NO: 319 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaatggcgctggataaagtgtttgcggaagtggcgtaa

SEQ ID NO: 320 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEMALDKVFAEVA

SEQ ID NO: 321 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagggggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 322 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKGAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 323 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggccgtatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 324 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 325 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgggctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcggggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgccgtccgctgggtcagagcgtggttctggcaccgccgtacattctgaccgaagcgcagatggatgaaatgttcgataaactggaaaaagcgctggataaagtgtttgcggaagtggcgtaa

SEQ ID NO: 326 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIGEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 327 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccggttggccagagcgtggttctggcaccgccgtacattctgaccgaagcgcagatggatgaaatgttcgataaactggaaaaagcgctggataaagtgtttgcggaagtggcgtaa

SEQ ID NO: 328 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLYNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPVGQSVVLAPPYILTEAQMDEMFDKLEKALDKVFAEVA

SEQ ID NO: 329 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaggcgctggataaagtgtttgcggaagtggcgtaa

SEQ ID NO: 330 - protein, 453 aa, Artificial Sequence
  Variant of Transaminase enzyme from Vibrio fluvialis
MNKPQSWETRAEEVSLYAFTHMPSLRQRGTMVVTHGEGPYIVDVHGRRYLDANSGLFNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 331 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 332 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 333 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgaagagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttattccggatgcgattattagcagtaaaaacctaaccgcgggtttttttccagtaggagcggtgattttggggccggaactgagcaaacgtctggaaaccgcgattgaagcgatcggggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatgataacctgagcgtgagcgaacgtattgcgaacacctgcaccgatctgggactgatttgcgcgccgggcggtcagagcgtggttctggcaccgccgtacattctgaccgaagtacagatggatgaaatgttcgataaactggaaaaagcgctggataaagtgtttgcggaagtggcgtaa

SEQ ID NO: 334 - protein, 453 aa, Artificial Sequence
  Variant of Transaminase enzyme from Vibrio fluvialis
MNKPQSWETRAETVSLYAFTHMKSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFIPDAIISSKNLTAGFFPVGAVILGPELSKRLETAIEAIGEFDHGFTTGGHPVGCAIALKAIDVVMNEGLAENVRRLAPRFEERLKHIAERPNIGEYRGVGFMWALEVVKDKASKAPFDDNLSVSERIANTCTDLGLICAPGGQSVVLAPPYILTEVQMDEMFDKLEKALDKVFAEVA

SEQ ID NO: 335 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 336 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWYLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 337 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtacctgcatcgtgcggaaggcaaaccgcagaaacgtaaaattctgaccctgaagggggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgattggccagagcgtggttctggcaccgccgtacattctgaccgaagcgcagatggatgaaatgttcgataaactggaaaaggcgctggataaagtgtttgcggaagtggcgtaa

SEQ ID NO: 338 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLYNMVAGFDHKGLIDAAKAQYERFPGYHAFYGLMSDQTVMLSEKLVEVSPFDSGRVFVTNSGSEANETMVKMLWYLHRAEGKPQKRKILTLKGAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPIGQSVVLAPPYILTEAQMDEMFDKLEKALDKVFAEVA

SEQ ID NO: 339 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 340 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 341 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatatcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgaccgttgggccagagcgtggttctggcaccgccgtacattctgaccgaagcgcagatggatgaaatgttcgataaactggaaaaagcgctggataaagtgtttgcggaagtggcgtaa

SEQ ID NO: 342 - protein, 453 aa, Artificial Sequence
  Variant of Transaminase enzyme from Vibrio fluvialis
MNKPQSWETRAEAVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 343 - DNA, 1362 bp, Artificial Sequence
  Variant of Transaminase enzyme from Vibrio fluvialis
atgaacaaaccgcagagctgggaaacgcgtgcggaaactgtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggccgtatgagcgatcagaccgtgatgctgtcggaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaatggcgctggataaagtgtttgcggaagtggcgtaa

SEQ ID NO: 344 - protein, 453 aa, Artificial Sequence
  Variant of Transaminase enzyme from Vibrio fluvialis
MNKPQSWETRAETVSLYAFTHMPSLRQRGTMVVTHGEGPYVVDVHGRRYLDANSGLFNMVAGFDHKGLIDAAKAQYERFPGYHAFYGRMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

SEQ ID NO: 345 - DNA, 1362 bp, Artificial Sequence
  Variant of Transaminase enzyme from Vibrio fluvialis
atgaacaaaccgcagagctgggaaacgcgtgcggaagcggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtttaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggttcctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgcagcccgctgggccagagcgtggttctggcaccgccgtacattctgaccgaagcgcagatggatgaaatgttcgataaactggaaaaagcgctggataaagtgtttgcggaagtggcgtaa

SEQ ID NO: 346 - protein, 453 aa, Artificial Sequence
  Variant of Transaminase enzyme from Vibrio fluvialis
MNKPQSWETRAEAVSLYAFTHMPSLRQRGTMVVTHGEGPYVVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICSPLGQSVVLAPPYILTEAQMDEMFDKLEKALDKVFAEVA

SEQ ID NO: 347 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgcgcgccgggcgatcagagcgtggttctggcaccgccgtacattctgaccgaagcgcagatggatgaaatgttcgataaactggaaaaagcgctggataaagtgtttgcggaagtggcgtaa

SEQ ID NO: 348 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICAPGDQSVVLAPPYILTEAQMDEMFDKLEKALDKVFAEVA

SEQ ID NO: 349 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgtgtagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgcgctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttactccggatgcgattattagcagtaaaaacctaaccgcgggtttttttccagtaggagcggtgattttggggccggaactgagcaaacgtctggaaaccgcgattgaagcgatcgaggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgccgtccgctggatcagagcgtggttctggcaccgccgtacattctgaccgaagtacagatggatgaaatgttcgataaactggaaaaagcgctggataaagtgtttgcggaagtggcgtaa

SEQ ID NO: 350 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDACSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTALGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLDQSVVLAPPYILTEVQMDEMFDKLEKALDKVFAEVA

SEQ ID NO: 351 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgccgagcctacgtcagcgtggcaccatggtggtaacccatggcgaaggcccgtatatcgtggatgtgcatggccgtcgttatctggatgcgtgtagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgggctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttattccggatgcgattattagcagtaaaaacctaaccgcgggtttttttccagtaggagcggtgattttggggccggaactgagcaaacgtctggaaaccgcgattgaagcgatcgaggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatgataacctgagcgtgagcgaacgtattgcgaacacctgcaccgatctgggactgatttgccgaccgttgggccagagcgtggttctggcaccgccgtacattctgaccgaagcacagatggatgaaatgttcgataaactggaaaaagcgctggataaagtgtttgcggaagtggcgtaa

SEQ ID NO: 352 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDACSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFIPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDDNLSVSERIANTCTDLGLICRPLGQSVVLAPPYILTEAQMDEMFDKLEKALDKVFAEVA

SEQ ID NO: 353 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgaacagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgcgctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaggaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgccgtccgctggatcagagcgtggttctggcaccgccgtacattctgaccgaagcgcagatggatgaaatgttcgataaactggaaaaagcgctggataaagtgtttgcggaagtggcgtaa

SEQ ID NO: 354 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDANSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTALGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLDQSVVLAPPYILTEAQMDEMFDKLEKALDKVFAEVA

SEQ ID NO: 355 - DNA, 1362 bp, Artificial Sequence
  Variant of Transaminase enzyme from Vibrio fluvialis
atgaacaaaccgcagagctgggaaacgcgtgcggaaaccgtgagcctgtatgcctttacccacatgcctagcctacgtcagcgtggcaccatggtggtaacccatggcgaaggcccgtatatcgtggatgtgcatggccgtcgttatctggatgcgtgtagcggcctgttcaacatggtggcgggctttgatcataaaggcctgattgatgcggcgaaagcgcagtatgaacgttttccgggctatcatgcgttttacggcctgatgagcgatcagaccgtgatgctgtctgaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccgggctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattatcccgccaaaaggctattttcaggcgattctgaccatcctgcgcaaatatgatattccggtgatcagcgatgaagtgatttgcggctttggtcgtaccggcaacacctggggctgcgtgacctatgattttactccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggtaacctgagcgtgagcgaacgtattgcgaacacctgcaccgatctgggactgatttgccgtccgctgggtcagagcgtggttctggcaccgccgtacattctgaccgaagcacagatggatgaaatgttcgataaactggaaaaagcgctggataaagtgtttgcggaagtggcgtaa

SEQ ID NO: 356 - protein, 453 aa, Artificial Sequence
  Variant of Transaminase enzyme from Vibrio fluvialis
MNKPQSWETRAETVSLYAFTHMPSLRQRGTMVVTHGEGPYIVDVHGRRYLDACSGLFNMVAGFDHKGLIDAAKAQYERFPGYHAFYGLMSDQTVMLSEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVIIPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEKALDKVFAEVA

SEQ ID NO: 357 - DNA, 1362 bp, Artificial Sequence
  Variant of Transaminase enzyme from Vibrio fluvialis
atgaacaaaccgcagagctgggaaacgcgtgcggaagaggtgagcctgtatgcctttacccacatgccgagcctacgtcagcgtggcaccatggtggtaacccatggcgaaggcccgtatgtcgtggatgtgcatggccgtcgttatctggatgcgaacagcggcctgtataacatggtggcgggctttgatcataaaggcctgattgatgcggcgaaagcgcagtatgaacgttttccgggctatcatgcgttttacggcctgatgagcgatcagaccgtgatgctggcggaaaaactggtggaagtgagcccgtttgatagcggccgtgtgtttgtgaccaacagcggcagcgaagcgaacgaaaccatggtgaaaatgctgtggtttctgcatcgtgcggaaggcaaaccgcagaaacgtaaaattctgaccctgaagcaggcgtatcatggctccaccgcggtgagcgcgagcatgaccggcctgggctataacagcaaatttggcctgccgctgccgggctttctgcatctgacctgcccgcattattggcgttatggcgaagaaggcgaaaccgaagaacagtttgtcgcgcgtctggcccgtgaactggaagaaaccattcagaaggaaggcgcggataccattgcgggcttttttgcggaaccggtgatggctgcgggcggtgttattaccccgccaaaaggctattttcaggcgattctgaccatcctgcgcaaatatgatattccggtgatcagcgatgaagtgatttgcggctttggtcgtaccggcaacacctggggctgcgtgacctatgattttaccccggatgcgattattagcagtaaaaacctaaccgcgggtttttttccagtaggagcggtgattttggggccggaactgagcaaacgtctggaaaccgcgattgaagcgatcgaagaatttgatcatggttttaccacaggcggccatccggtgggttgtgcgattgcgctgaaagcgattgatgtggtgatgaacgaaggcctggccgaaaacgtgcgtcgtctggccccgcgttttgaagaacgtctgaaacatattgcggaacgtccgaacattggcgaatatcgtggtgtgggctttatgtgggcgctggaagtggtgaaagataaagcgagcaaagccccgtttgatggcaacctgagcgtgagcgaacgtattgcgaacacctgcaccgatctgggactgatttgccgcccgctgggccagagcgtggttctggcaccgccgtacattctgaccgaagcgcagatggatgaaatgttcgataaactggaaatggcgctggataaagtgtttgcggaagtggcgtaa

SEQ ID NO: 358 - protein, 453 aa, Artificial Sequence
  Variant of Transaminase enzyme from Vibrio fluvialis
MNKPQSWETRAEEVSLYAFTHMPSLRQRGTMVVTHGEGPYVVDVHGRRYLDANSGLYNMVAGFDHKGLIDAAKAQYERFPGYHAFYGLMSDQTVMLAEKLVEVSPFDSGRVFVTNSGSEANETMVKMLWFLHRAEGKPQKRKILTLKQAYHGSTAVSASMTGLGYNSKFGLPLPGFLHLTCPHYWRYGEEGETEEQFVARLARELEETIQKEGADTIAGFFAEPVMAAGGVITPPKGYFQAILTILRKYDIPVISDEVICGFGRTGNTWGCVTYDFTPDAIISSKNLTAGFFPVGAVILGPELSKRLETAIEAIEEFDHGFTTGGHPVGCAIALKAIDVVMNEGLAENVRRLAPRFEERLKHIAERPNIGEYRGVGFMWALEVVKDKASKAPFDGNLSVSERIANTCTDLGLICRPLGQSVVLAPPYILTEAQMDEMFDKLEMALDKVFAEVA

What is claimed is:

1. An engineered transaminase comprising a polypeptide sequence having at least 85%, 86%, 87%, 88%, 89%, 90%, 91%, 92%, 93%, 94%, 95%, 96%, 97%, 98%, 99%, sequence identity to SEQ ID NO: 6, or a functional fragment thereof, wherein said engineered transaminase comprises a 130Y substitution in said polypeptide sequence, and wherein the amino acid positions of said polypeptide sequence are numbered with reference to SEQ ID NO: 6, and wherein the engineered transaminase has an increased activity as compared to the polypeptide of SEQ ID NO: 4 in converting 1-imidazo[1,2-a]pyridin-6-ylethanone (compound (2)) to (1S)-1-imidazo[1,2-a]pyridin-6-ylethanamine (compound (3)).

2. The engineered transaminase of claim 1, wherein said polypeptide sequence has at least 85%, 86%, 87%, 88%, 89%, 90%, 91%, 92%, 93%, 94%, 95%, 96%, 97%, 98%, 99%, sequence identity to SEQ ID NO: 6, wherein said engineered transaminase further comprises at least one substitution or substitution set in said polypeptide sequence at one or more positions selected from 13, 13/41/57/88/130/415/417, 13/41/57/89/97/417, 13/41/57/97/415/417, 13/41/57/97/415/417/443, 13/41/57/97/443, 13/41/57/417, 13/41/57/417, 13/41/88, 13/41/88/89, 13/41/88/89/97/415/443, 13/41/88/89/417, 13/41/88/97, 13/41/88/415/443, 13/41/88/443, 13/41/89/148/443, 13/41/89/417, 13/41/89/443, 13/41/97/417, 13/41/97/415, 13/41/97/415/417, 13/41/97/417, 13/41/97/417/443, 13/41/130/415/443, 13/41/415, 13/41/415/417, 13/41/415/443, 13/41/417, 13/41/417/443, 13/57/88/89/415/443, 13/57/88/97, 13/57/88/97/415/443, 13/57/88/415, 13/57/88/130/417/443, 13/57/88/415, 13/57/97/415/417/443, 13/57/97/417, 13/88/89/415/417, 13/88/89/415/417/443, 13/88/443, 13/88/415, 13/89/97/415/417, 13/89/97/417, 13/89/417, 13/97/148/415, 13/97/415, 13/97/415/417, 13/97/417, 13/415, 13/415/417, 13/417, 13/417/443, 13/415, 13/415/417, 13/415/417/443, 13/415/443, 13/417, 13/417/443, 13/443, 23/53/162/233/277/315/415/418/432, 23/53/315/417/418, 23/277/315/395/415/417/432, 23/277/395/417/418, 23/395/418, 23/418, 41, 41/57/88, 41/57/88/415/443, 41/57/148/415/417, 41/57/443, 41/57/415/417, 41/88/89/97/415, 41/88/89/415/417, 41/88/97/417, 41/88/415/417, 41/88/443, 41/97/148/415/417/443, 41/97/417, 41/97/417/443, 41/415, 41/415/417/443, 41/415/443, 41/415/443, 41/417, 41/417/443, 53/162, 53/162/395/417, 53/162/418/432, 53/233, 53/277/395, 53/277/395/417/418, 53/277/415/417, 57/88/97/415/443, 57/88/97/417, 57/88/97/417, 57/97/148/417/443, 57/417, 88, 88/89/417, 88/97/415/417/443, 88/417/443, 88/148/417/443, 88/415, 88/415/417, 88/415/417/443, 88/417, 89/97/415/417, 89/97/417, 89/443, 97, 97/148/415, 97/415, 97/415/417, 97/417, 415, 417, 443, 162/233/415/417, 162/395/415/417, 162/418, 233/315/415/417, 233/315/417, 277/395/415/418/432, 315, 315/415/418/432, 395/418, 415, 415/417, 415/417/418, 415/417/418/432, 415/417/443, 415/443, 417, and 443, and wherein the amino acid positions of said polypeptide sequence are numbered with reference to SEQ ID NO: 6.

3. The engineered polypeptide of claim 2 in which the residue differences at the residue positions 13, 41/57/415/419, 41/113/415, 53/57, 88, 88/89, 97/415, 148, 227, 260, 302, 355/415/419, 362, 417, and 443 are selected from 13A, 13E, 13G, 13K, 13S, 41V/57Y/415F/419D, 41V/113F/415F, 53M/57W, 88K, 88R, 88R/89L, 88V, 97A/415S, 148E, 148G, 260T, 302N, 355C/415S/419D, 362G, 417A, 417I, 417V, 443E, and 443M.

4. The engineered polypeptide of claim 1 in which the amino acid sequence further comprises a combination of residue differences as compared to SEQ ID NO: 6 selected from:

T13A;
T13E;
T13G;
T13K;
T13S;
I41V, F57Y, R415F, and Q419D;
I41V, V113F, and R415F;
N53M and F57W;
L88K;
L88R;
L88R and M89L;
L88V;

S97A and R415S;
Q148E;
Q148G;
C260T;
E302N;
R355C, R415S, and Q419D;
H362G;
L417A;
L417I;
L417V;
K443E; and
K443M.

5. The engineered polypeptide of claim 1 in which the transaminase has at least 1.2 fold increased activity as compared to the polypeptide of SEQ ID NO: 4 in converting 1-imidazo[1,2-a]pyridin-6-ylethanone (compound (2)) to (1S)-1-imidazo[1,2-a]pyridin-6-ylethanamine (compound (3)).

6. The engineered polypeptide of claim 1 in which further the transaminase has increased enantioselectivity as compared to the polypeptide of SEQ ID NO: 4 in converting 1-imidazo[1,2-a]pyridin-6-ylethanone (compound (2)) to (1S)-1-imidazo[1,2-a]pyridin-6-ylethanamine (compound (3)).

7. The engineered polypeptide of claim 1 in which the amino acid sequence comprises a sequence selected from SEQ ID NO: 64, 66, 68, 76, 84, 88, 94, 110, 112, 118, 120, 124, 126, 128, 132, 138, 144, 150, 170, 182, 202, 206, 224, 226, 240, 246, 274, 276, 282, 294, 296, 302, 310, 312, 332, 336, and 338.

8. The engineered polypeptide of claim 1 in which the polypeptide is immobilized on a solid support.

9. The engineered polypeptide of claim 8 in which the solid support is a bead or resin comprising polymethacrylate with epoxide functional groups, polymethacrylate with amino epoxide functional groups, styrene/DVB copolymer or polymethacrylate with octadecyl functional groups.

* * * * *